(12) United States Patent
Punnonen et al.

(10) Patent No.: US 7,094,875 B2
(45) Date of Patent: Aug. 22, 2006

(54) CO-STIMULATORY POLYPEPTIDES

(75) Inventors: Juha Punnonen, Belmont, CA (US); Alexandra L. L. Lazetic, San Jose, CA (US); Steven R. Leong, Berkeley, CA (US); Chia-Chun Chang, Los Gatos, CA (US)

(73) Assignee: Maxygen, Inc., Redwood City, CA (US)

( * ) Notice: Subject to any disclaimer, the term of this patent is extended or adjusted under 35 U.S.C. 154(b) by 676 days.

(21) Appl. No.: 09/888,324

(22) Filed: Jun. 22, 2001

(65) Prior Publication Data

US 2003/0190697 A1    Oct. 9, 2003

Related U.S. Application Data

(60) Provisional application No. 60/241,245, filed on Oct. 17, 2000, provisional application No. 60/213,946, filed on Jun. 23, 2000.

(51) Int. Cl.
C07K 14/725 (2006.01)
C12P 21/00 (2006.01)

(52) U.S. Cl. .............. 530/350; 530/351; 530/387.1; 514/21; 435/69.1

(58) Field of Classification Search .......... 530/350, 530/351, 387.1; 514/21
See application file for complete search history.

(56) References Cited

U.S. PATENT DOCUMENTS

| | | | |
|---|---|---|---|
| 5,512,463 A | 4/1996 | Stemmer | |
| 5,514,588 A | 5/1996 | Varadaraj | |
| 5,605,793 A | 2/1997 | Stemmer | |
| 5,718,883 A | 2/1998 | Harlan et al. | |
| 5,738,852 A | 4/1998 | Robinson et al. | |
| 5,763,239 A | 6/1998 | Short et al. | |
| 5,789,228 A | 8/1998 | Lam et al. | |
| 5,811,238 A | 9/1998 | Stemmer et al. | |
| 5,814,473 A | 9/1998 | Warren et al. | |
| 5,824,469 A | 10/1998 | Horwitz et al. | |
| 5,830,696 A | 11/1998 | Short | |
| 5,830,721 A | 11/1998 | Stemmer et al. | |
| 5,834,252 A | 11/1998 | Stemmer et al. | |
| 5,837,458 A | 11/1998 | Minushull et al. | |
| 5,858,776 A | 1/1999 | Ostrand-Rosenberg et al. | |
| 5,861,310 A | 1/1999 | Freeman et al. | |
| 5,866,363 A | 2/1999 | Pieczenik | |
| 5,876,997 A | 3/1999 | Kretz | |
| 5,925,749 A | 7/1999 | Mathur et al. | |
| 5,928,905 A | 7/1999 | Stemmer et al. | |
| 5,939,250 A | 8/1999 | Short | |
| 5,939,300 A | 8/1999 | Robertson et al. | |
| 5,942,430 A | 8/1999 | Robertson et al. | |
| 5,948,666 A | 9/1999 | Callen et al. | |
| 5,958,672 A | 9/1999 | Short | |
| 5,958,751 A | 9/1999 | Murphy et al. | |
| 5,962,258 A | 10/1999 | Mathur et al. | |
| 5,962,283 A | 10/1999 | Warren et al. | |
| 5,965,408 A | 10/1999 | Short | |
| 5,985,646 A | 11/1999 | Murphy et al. | |
| 6,001,574 A | 12/1999 | Short et al. | |
| 6,004,788 A | 12/1999 | Short | |
| 6,030,779 A | 2/2000 | Short | |
| 6,045,802 A | 4/2000 | Schlom et al. | |
| 6,054,267 A | 4/2000 | Short | |
| 6,057,103 A | 5/2000 | Short | |
| 6,071,716 A | 6/2000 | Freeman et al. | |
| 6,084,067 A | 7/2000 | Freeman et al. | |
| 6,096,548 A | 8/2000 | Stemmer | |
| 6,117,679 A | 9/2000 | Stemmer | |
| 6,132,970 A | 10/2000 | Stemmer | |
| 6,149,905 A | 11/2000 | Ostrand-Rosenberg et al. | |
| 6,165,793 A | 12/2000 | Stemmer | |
| 6,168,919 B1 | 1/2001 | Short | |
| 6,171,820 B1 | 1/2001 | Short | |
| 6,174,673 B1 | 1/2001 | Short et al. | |
| 6,180,406 B1 | 1/2001 | Stemmer | |
| 6,238,884 B1 | 5/2001 | Short et al. | |

FOREIGN PATENT DOCUMENTS

| | | |
|---|---|---|
| EP | 0911396 A2 | 4/1999 |
| EP | 0911396 A3 | 5/1999 |
| EP | 0934999 A1 | 8/1999 |
| WO | WO 94/24267 | 10/1994 |
| WO | WO 95/03408 | 2/1995 |
| WO | WO 95/23859 | 9/1995 |
| WO | WO 97/07205 | 2/1997 |
| WO | WO 97/20078 | 6/1997 |
| WO | WO 97/25410 | 7/1997 |

(Continued)

OTHER PUBLICATIONS

Bowie et al., Science, 1990, vol. 247, pp. 1306-1310.*

(Continued)

*Primary Examiner*—Phillip Gambel
*Assistant Examiner*—Ilia Ouspenski
(74) *Attorney, Agent, or Firm*—Margaret A. Powers; Norman J. Kruse

(57) ABSTRACT

The invention provides polynucleotides and polypeptides encoded therefrom having advantageous properties, including an ability of the polypeptides to preferentially bind a CD28 or CTLA-4 receptor at a level greater or less than the ability of human B7-1 to bind CD28 or CTLA-4, or to induce or inhibit altered level of T cell proliferation response greater compared to that generated by human B7-1. The polypeptides and polynucleotides of the invention are useful in therapeutic and prophylactic treatment methods, gene therapy applications, and vaccines.

53 Claims, 39 Drawing Sheets

FOREIGN PATENT DOCUMENTS

| | | |
|---|---|---|
| WO | WO 97/35957 | 10/1997 |
| WO | WO 97/35966 | 10/1997 |
| WO | WO 97/44361 | 11/1997 |
| WO | WO 97/48416 | 12/1997 |
| WO | WO 97/48717 | 12/1997 |
| WO | WO 97/48794 | 12/1997 |
| WO | WO 98/00526 | 1/1998 |
| WO | WO 98/01581 | 1/1998 |
| WO | WO 98/13485 | 4/1998 |
| WO | WO 98/13487 | 4/1998 |
| WO | WO 98/24799 | 6/1998 |
| WO | WO 98/27230 | 6/1998 |
| WO | WO 98/28416 | 7/1998 |
| WO | WO 98/31837 | 7/1998 |
| WO | WO 98/36080 | 8/1998 |
| WO | WO 98/41622 | 9/1998 |
| WO | WO 98/41623 | 9/1998 |
| WO | WO 98/41653 | 9/1998 |
| WO | WO 98/42832 | 10/1998 |
| WO | WO 98/48034 | 10/1998 |
| WO | WO 98/58085 | 12/1998 |
| WO | WO 99/07837 | 2/1999 |
| WO | WO 99/08539 | 2/1999 |
| WO | WO 99/10472 | 3/1999 |
| WO | WO 99/10539 | 3/1999 |
| WO | WO 99/19518 | 4/1999 |
| WO | WO 99/21979 | 5/1999 |
| WO | WO 99/23107 | 5/1999 |
| WO | WO 99/23236 | 5/1999 |
| WO | WO 99/29902 | 6/1999 |
| WO | WO 99/41368 | 8/1999 |
| WO | WO 99/41369 | 8/1999 |
| WO | WO 99/41383 | 8/1999 |
| WO | WO 99/41402 | 8/1999 |
| WO | WO 99/43839 | 9/1999 |
| WO | WO 99/45154 | 9/1999 |
| WO | WO 99/57128 | 11/1999 |
| WO | WO 99/57271 | 11/1999 |
| WO | WO 99/65927 | 12/1999 |
| WO | WO 00/42560 | 7/2000 |
| WO | WO 00/42561 | 7/2000 |
| WO | WO 00/53744 | 9/2000 |
| WO | WO 00/58517 | 10/2000 |

OTHER PUBLICATIONS

Burgess et al., J Cell Biol., 1990, vol. 111, pp. 2129-2138.*
Lazar et al., Mol Cell Biol., 1988, vol. 8, pp. 1247-1252.*
Metzler et al., Nature Structural Biol., 1997, vol. 4, pp. 527-531.*
Parsons et al., Immunogenetics, 1999, vol. 49, pp. 231-234.*
Lederman et al., Molecular Immunology, 1991, vol. 28, pp. 1171-1181.*
Coleman et al., Research in Immunology, 1994, vol. 145, pp. 33-36.*
Abaza et al., Journal of Protein Chemistry, 1992, vol. 11, pp. 433-444.*
Chang, C., et al. (1999) "Evolution of a cytokine using DNA family shuffling." *Nature Biotechnology* 17:793-797.
Christians, F.C. et al., (1999) "Directed evolution of thymidine kinase for AZT phosphorylation using DNA family shuffling." *Nature Biotechnology* 17:259-264.
Coco et al., (2001) "DNA shuffling method for generating highly recombined genes and evolved enzymes" *Nature Biotechnology* vol. 19 pp. 354-359.
Crameri et al., (1993) "10(20)-Fold aptamer library amplification without gel purification," *Nuc. Acids Res.* 21(18):4410.
Crameri, A. & Stemmer W.P.C. (1995) "Combinatorial multiple cassette mutagenesis creates all the permutations of mutant and wildtype cassettes." *Biotechniques* 18:194-195.
Crameri, A. et al. (1996) "Improved green fluorescent protein by molecular evolution using DNA shuffling." *Nature Biotechnology* 14:315-319.
Crameri, A. et al. (1996) "Construction and evolution of antibody-phage libraries by DNA shuffling." *Nature Medicine* 2:100-103.
Crameri, A. et al., (1997) "Molecular evolution of an arsenate detoxification pathway by DNA shuffling." *Nature Biotechnology* 15:436-438.
Crameri, A. et al., (1998) "DNA shuffling of a family of genes from diverse species accelerates directed evolution," *Nature* 391:288-291.
Gates, C.M. et al., (1996) "Affinity selective isolation of ligands from peptide libraries through display on a lac repressor headpiece dimer". *Journal of Molecular Biology* 255:373-386.
Minshull, J., Stemmer, W.P.C. (1999) "Protein evolution by molecular breeding." *Current Opinion in Chemical Biology* 3:284-290.
Ness, J. et al., (1999) "DNA shuffling of subgenominc sequences of subtilisin." *Nature Biotechnology* 17:893-896.
Patten, P.A. et al., (1997) "Application of DNA Shuffling to Pharmaceuticals and Vaccines." *Current Opinion in Biotechnology* 8:724-733.
Pelletier, Joelle N., (2001) "A Rachitt for our toolbox" *Nature Biotechnology* vol. 19, p. 314-315.
Stemmer, W.P.C. (1994) "DNA Shuffling by random fragmentation and reassembly: In vitro recombination for molecular evolution." *PNAS* 91:10751.
Stemmer, W.P.C. (1994) "Rapid evolution of a protein in vitro by DNA shuffling." *Nature* 370:389-391.
Stemmer, W.P.C. (1995) "The Evolution of Molecular Computation." *Science* 270:1510.
Stemmer, W.P.C. (1995) "Searching Sequence Space." *Bio/Technology* 13:549-553.
Stemmer, W.P.C. (1996) "Sexual PCR and Assembly PCR." In: *The Encyclopedia of Molecular Biology*. VCH Publishers, New York, pp. 447-457.
Stemmer, W.P.C. & Soong, N.W. (1999) "Molecular breeding of viruses for targeting and other clinical properties." *Tumor Targeting* 4:59-62.
Zhang, J. et al., (1997) "Directed evolution of an effective fucosidase from a galactosidase by DNA shuffling and screening." *Proceedings of the National Academy of Sciences, USA* 94:4504-4509.
Freeman, G.J. et al., "Cloning of B7-2: A CTLA-4 Counter-Receptor That Costimulates Human T Cell Proliferation," Science 262:909-911 (1993).
He, X-S. et al., "Costimulatory protein B7-1 enhances the cytotoxic T cell response and antibody response to hepatitis B surface antigen," Proc. Natl. Acad. Sci. USA 93:7274-7278 (1996).
Kin, J.J. et al., "Engineering DNA Vaccines via Co-delivery of Co-Stimulatory Molecule Genes," Vaccine 16(19):1828-1835 (1998).
Kuchroo, V.K. et al., "B7-1 and B7-2 Costimulatory Molecules Activate Differentially the Th1/Th2 Developmental Pathways: Application to Autoimmune Disease Therapy," Cell 80:707-718 (1995).
Metzler, W., et al., "Solution Structure of Human CTLA-4 and Delineation of a CD80/CD86 Binding Site Conserved in CD28," Nature Structural Biology 4(7):527-531 (Jul. 1997).
Parsons, K.R., et al., "Cloning of Cattle CD80," Immunogenetics 49(3):231-234 (1999).
Rennert, P. et al., "The IgV domain of human B7-2 (CD86) is sufficient to co-stimulate T lymphocytes and induce cytokine secretion," International Immunology 9(6):805-813 (1997).
Wu, Y., "CTLA-4-B7 Interaction is Sufficient to Costimulate T Cell Clonal Expansion," J. Exp. Med. 185(7):1327-1335 (1997).
Peach, R.J., et al., *Journal of Biological Chemistry* (1995) 270(36):21181-21187.
Fargeas, C.A., et al., *Journal of Experimental Medicine* (1995) 182(3):667-675.

Faas, S.J., et al., *Journal of Immunology* (2000) 164(12):6340-6348.

Guo, Y., et al., *Journal of Experimental Medicine* (1995) 181(4):1345-1355.

Lazetic, S., et al., *Journal of Biological Chemistry* (2002) 277(41):38660-38668.

Doty, Raymond T. et al., "Subcellular localization of CD80 receptors is dependent on an intact cytoplasmic tail and is required for CD28-dependent T cell costimulation," *Journal of Immunology* 157:3270-3279 (1996).

Freeman, Gordon J. et al., "Cloning of B7-2: A CTLA-4 counter-receptor that costimulates human T cell proliferation," *Science* 262-:909-911 (Nov. 1993).

Jenkins, Marc K., "The ups and downs of T cell costimulation," *Immunity* 1:443-446 (Sep. 1994).

Karandikar, Nitin J. et al., "CTLA-4: A negative regulator of autoimmune disease," *J. Exp. Med.*, 184:783-788 (Aug. 1996).

Lazetic, Sasha et al., "Chimeric co-stimulatory molecules that selectively act through CD28 or CTLA-4 on human t cells," *Journal of Biological Chemistry* 277(41):38660-38666 (2002).

Linsley, Peter S. et al., "Human B7-1 (CD80) and B7-2 (CD86) bind with similar avidities but distinct kinetics to CD28 and CTLA-4 receptors," *Immunity* 1:793-801 (Dec. 1994).

Linsley, Peter S. et al., "Binding of the B cell activation antigen B7 to CD28 costimulates T cell proliferation and interleukin 2 mRNA accumulation," *J. Exp. Med.* 173:721-730 (Mar. 1991).

Patten, Phillip et al., "Applications of DNA shuffling to pharmaceuticals and vaccines," *Current Opinion in Biotechnology* 8:724-733 (1997).

Peach, Robert J. et al., "Both extracellular immunoglobin-like domains of CD80 contain residues critical for binding T cell surface receptors CTLA-4 and CD28," *Journal of Biological Chemistry* 270(86):21181-21187 (1995).

Stemmer, Willem P.C., "Searching sequence space: Using recombination to search more efficently and thoroughly instead of making bigger combinatorial libraries," *Biotechnology* 13:549-553 (Jun. 1995).

Sturmhoefel, Knut, "Potent activity of soluble B7-lgG fusion proteins in therapy of established tumors and as vaccine adjuvant," *Cancer Research* 59:4964-4972 (Oct. 1999).

Swiniarski, Holly et al., "Immune response enhancement by *in vivo* administration of B7.21g, a soluble costimulatory protein," *Clinical Immunology* 92(3):235-245 (1999).

* cited by examiner

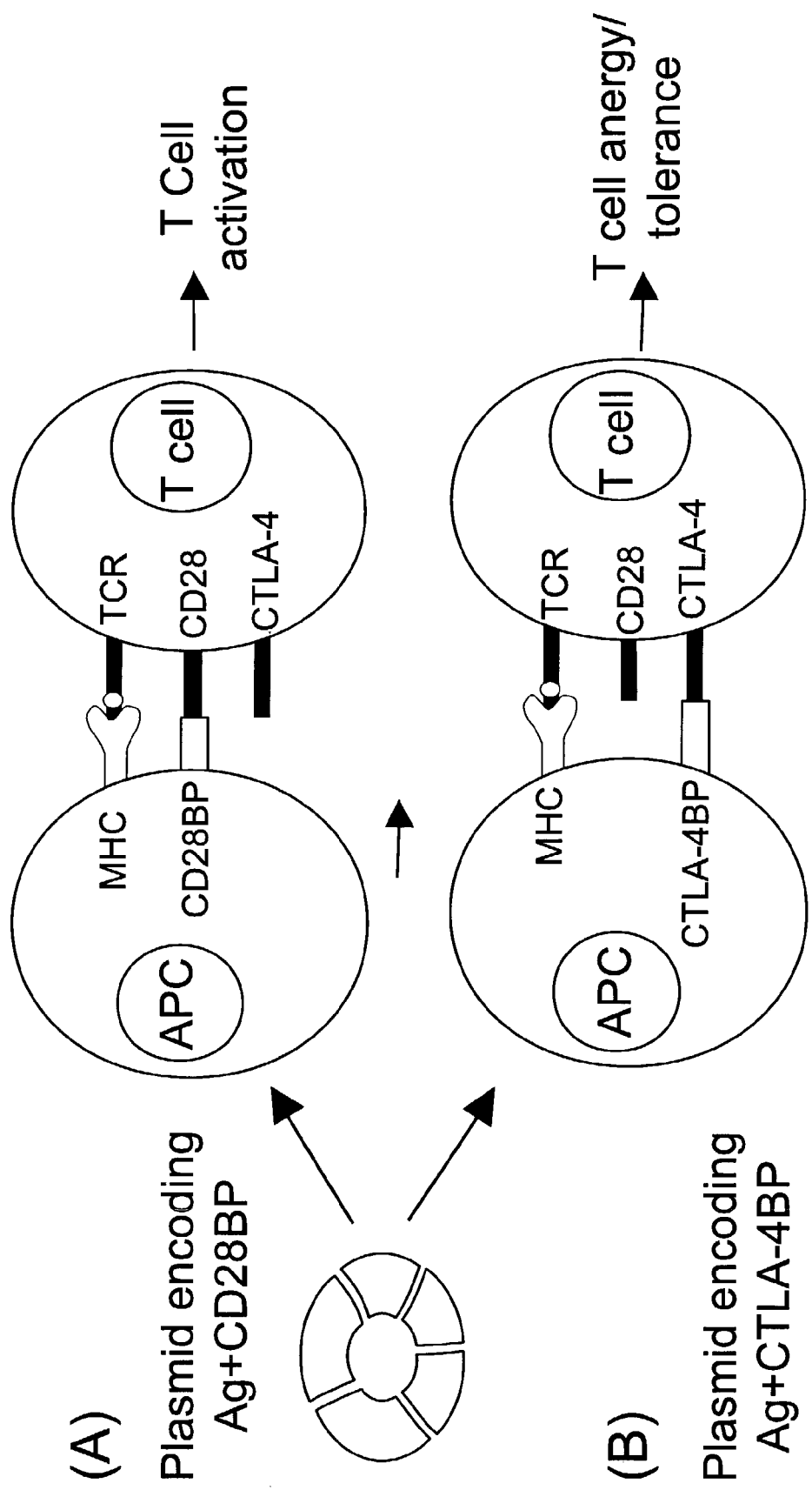

Fig. 2B

Extracellular domain (ECD)

```
                                    81                                                                                          160
SEQ:278_Human_37-1          (79)  GDMNIWPEYKNRTIFDITNNLSIVILALRPSDEGTYECVVLK-YEKDAFKREHLAEVTLSVKADFPTPSISDFEIPTSNI SEQ:048_R1_Clone_71         (81)  GKVQVWPEYKNRTIFDITNNLSIVILALRLSDSGTYTCVIQKPVLKGAYKLEHLASVRLMIRADFPVPTINDLGNPSPNI
SEQ:049_R1_Clone_84         (78)  GQVEVWPEYKNRTIFDITNNLSIVILALRLSDSGTYTCVIQKPVLKGAYKLEHLASVRLMIRADFPVPTINDLGNPSPNI
SEQ:050_R1_Clone_118        (78)  GQVEVWPEYKNRTFPDIINNLSLMILALRLSDSGTYTCVIQKPVLKGAYKLEHLASVRLMIRADSPVPSITDIGHPAPNV
SEQ:051_R1_Clone_126        (81)  GKVQVWPEYKNRTFPDIINNLSLMILALRLSDSGTYTCVIQKPVLKGAYKLEHLTSVTLSIRADFPVPSITDIGHPAPNV
SEQ:052_R2_CD28BP-1         (81)  GKVQVWPEYKNRTIFDITNNLSIVILALRLSDSGTYTCVIQKPDLKGAYKLEHLTSVRLMIRADFPVPTINDLGNPSPNI
SEQ:053_R2_CD28BP-2         (81)  GKVQVWPEYKNRTIFDITNNLSIVILALRLSDSGTYTCVIQKPVLKGAYKLEHLASVRLMIRADFPVPTINDLGNPSPNI
SEQ:054_R2_CD28BP-3         (81)  GKVQVWPEYKNRTIFDITNNLSIVILALRLSDSGTYTCVIQKPVLKGAYKLEHLASVRLMIRADFPVPTINDLGNPSPNI
SEQ:055_R2_CD28BP-4         (81)  GKVQVWPEYKNRTIFDITNNLSIVILALRLSDSGTYTCVIQKPVLKGAYKLEHLASVRLMIRADFPVPTINDLGNPSPNI
SEQ:056_R2_CD28BP-5         (81)  GKVQVWPEYKNRTIFDITNNLSIVILALRLSDKGTYTCVIQKPVLKGAYKLEHLASVRLMIRADFPVPTINDLGNPSPNI
SEQ:057_R2_CD28BP-6         (81)  GKVQVWPEYKNRTIFDITNNLSIVILALRLSDSGTYTCVIQKPVLKGAYKLEHLTSVTLSIRADFPVPSITDIGHPAPNV
SEQ:058_R2_CD28BP-7         (81)  GKVQVWPEYKNRTIFDITNNLSIVILALRLSDSGTYTCVIQKPVLKGAYKLEHLTSVRLMIRADFPVPTINDLGNPSPNI
SEQ:059_R2_CD28BP-8         (81)  GKVQVWPEYKNRTIFDITNNLSIVILALRLSDSGTYTCVIQKPVLKGAYKLEHLASVRLMIRADFPVPTINDLGNPSPNI
SEQ:060_R2_CD28BP-9         (81)  GKVQVWPEYKNRTIFDITNNLSIVILALRLSDSGTYTCVVQK-NENGSFRREHLTSVTLSIRADFPVPSITDIGHPAPNV
SEQ:061_R2_CD28BP-10        (81)  GKVQVWPEYKNRTIFDITNNLSIVILALRLSDSGTYTCVIQKPVLKGAYKLEHLASVRLMIRADFPVPTINDLGNPSPNI
SEQ:062_R2_CD28BP-11        (81)  GKVQVWPEYKNRTIFDITNNLSIVILALRLSDSGTYTCVIQKPVLKGAYKLEHLASVRLMIRADFPVPTINDLGNPSPNI
SEQ:063_R2_CD28BP-12        (81)  GKVQVWPEYKNRTIFDITNNLSIVILALRLSDSGTYTCVVQK-NENGSFRREHLTSVTLSIRADFPVPSITDIGHPAPNV
SEQ:064_R2_CD28BP-13        (81)  GKVQVWPEYKNRTIFDITNNLSIVILALRLSDSGTYTCVIQKPVLKGAYKLEHLASVRLMIRADFPVPTINDLGNPSPNI
SEQ:065_R2_CD28BP-14        (78)  GQVEVWPEYKNRTIFDITNNLSIVILALRLSDSGTYTCVIQKPVLKGAYKLEHLASVRLMIRADFPVPTINDLGNPSPNI
SEQ:066_R2_CD28BP-15        (81)  GKVQVWPEYKNRTIFDITNNLSIVILALRPSDSGTYTCVIQKPVLKGAYKLEHLTSVRLMIRADFPVPTINDLGNPSPNI
SEQ:067_R2_CD28BP-16        (81)  GKVQVWPEYKNRTIFDITNNLSIVILALRLSDSGTYTCVIQKPVLKGAYKLEHLTSVRLMIRADFPVPTINDLGNPSPNI
SEQ:068_R2_CD28BP-17        (81)  GKVQVWPEYKNRTIFDITNNLSIVILALRLSDKGTYTCVVQK-NENGSFRREHLTSVTLSIRADFPVPSITDIGHPAPNV
SEQ:174_cd28a12-5           (81)  GKVQVWPEYKNRTIFDITNNLSIVILALRLSDSGTYTCVIQKPVLKGAYKLEHLASVRLMIRADFPVPTINDLGNPSPNI
SEQ:175_cd28a4-5star        (81)  GKVQVWPEYKNRTIFDITNNLSLMILALRIVILALRLSDSGTYTCVIQKPVLKGAYKLEHLTSVRLMIRADFPVPTINDLGNPSPNI
SEQ:176_cd28A4-9            (81)  GKVQVWPEYKNRTIFDITNMDNPRIVILALRLSDSGTYTCVIQKPVLKGAYKLEHLTSVRLMIRADFPVPTINDLGNPSPNI
SEQ:177_cd28A6-9            (81)  GKVQVWPEYKNRTIFDITDMDNPRIVILALRLSDSGTYTCVIQKPVLKGAYKLEHLTSVRLMIRADFPVPTINDLGNPSPNI
SEQ:178_cd28A6-1            (81)  GKVQVWPEYKNRTIFDITDMDNPRIVILALRLSDSGTYTCVIQKPVLKGAYKLEHLTSVRLMIRADFPVPTINDLGNPSPNI
SEQ:179_cd28A8-4            (81)  GKVQVWPEYKNRTIFDITDMDNPRIVILALRLSDSGTYTCVIQKPVLKGAYKLEHLTSVRLMIRADFPVPTINDLGNPSPNI
SEQ:180_cd28A8-6            (81)  GKVQVWPEYKNRTIFDITDMDNPRIVILALRLSDSGTYTCVIQKPVLKGAYKLEHLTSVRLMIRADFPVPTINDLGNPSPNI
SEQ:181_cd28B2-8            (81)  GKVQVWPEYKNRTIFDITDMDNPRIVILALRLSDSGTYTCVIQKPVLKGAYKLEHLTSVRLMIRADFPVPTINDLGNPSPNI
SEQ:182_cd28B4-3            (81)  GKVQVWPEYKNRTIFDITDMDNPRIVILALRLSDSGTYTCVIQKPVLKGAYKLEHLTSVRLMIRADFPVPTINDLGNPSPNI
SEQ:183_cd28B6-3            (81)  GKVQVWPEYKNRTIFDITDMDNPRIVILALRLSDKGTYTCVIQKPDLKGAYKLEHLTSVRLMIRADFPVPTINDLGNPSPNI
SEQ:184_cd28b6-6            (81)  GKVQVWPEYKNRTIFDITDMDNPRIVILALRLSDSGTYTCVIQKPVLKGAYKLEHLTSVTLSIRADFPVPSITDIGHPAPNV
SEQ:185_cd28b8-5star        (81)  GKVQVWPEYKNRTIFDITDMDNPRIVILALRLSDSGTYTCVIQKPVLKGAYKLEHLTSVRLMIRADFPVPTINDLGNPSPNI
SEQ:186_cd28c11-5           (81)  GKVQVWPEYKNRTIFDITDMDNPRIVILALRLSDSGTYTCVIQKPVLKGAYKLEHLTSVRLMIRADFPVPTINDLGNPSPNI
```

Fig. 2C

| | | 81 | 160 |
|---|---|---|---|
| SEQ:187_cd28C6-1 | (81) | GKVQVWPEYKNRTITDMNDNPRIVILALRLSDSGTYTCVIQKPVLKGAYKLEHLASVRLMIRADFPVPTINDLGNPSPNI | |
| SEQ:188_cd28C7-3 | (81) | GKVQVWPEYKNRTITDMNDNPRIVILALRLSDSGTYTCVIQKPDLKGAYKLEHLTSVRLMIRADFPVPSITDIGHPAPNV | |
| SEQ:189_cd28C8-6 | (81) | GKVQVWPEYKNRTITDMNDNPRIVILALRLSDSGTYTCVIQKPVLKGAYKLEHLASVRLMIRADFPVPTINDLGNPSPNI | |
| SEQ:190_cd28c9-5star | (78) | GQVEVWPEYKNRTITDMNDNPRIVILALRLSDSGTYTCVIQKPVLKGAYKPEHLASVRLMIRADFPVPTINDLGNPSPNI | |
| SEQ:191_cd28C2-4 | (81) | GKVQVWPEYKNRTITDMNDNPRIVIQALRLSDSGTYTCVIQKPVLKGAYKLEHLASVRLMIRADFPVP--TDLGNPSPNI | |
| SEQ:192_cd28D2-3 | (81) | GKVQVWPEYKNRTITDMNDNPRIVILALRLSDSGTYTCVIQKPVLKGAYKLEHLTSVRLMIRADFPVPTINDLGNPSPNI | |
| SEQ:193_cd28D2-9 | (81) | GKVQVWPEYKNRTITDMNDNPRIVILALRLSDSGTYTCVIQKPVLKGAYKLEHLTSVRLMIRADFPVP--TDLGNPSPNI | |
| SEQ:194_cd28D8-9 | (81) | GKVQVWPEYKNRTITDMNDNPRIVILALRLSDSGTYTCVIQKPVLKGAYKLEHLTSVRLMIRADFPVPTINDLGNPSPNI | |
| SEQ:195_cd28D11-1 | (81) | GKVQVWPEYKNRTITDMNDNPRIVILALRLSDSGTYTCVVQK-NENGSFRREHLTSVTLSIRADFPVPSITDIGHPAPNV | |
| SEQ:196_cd28D12-5 | (81) | GKVQVWPEYKNRTITDMNDNPRIVILALRLSDSGTYTCVIQKPVLKGAYKLEHLASVRLMIRADFPVPSITDIGHPAPNV | |
| SEQ:197_cd28E10-6 | (81) | GKVQVWPEYKNRTITDMNDNPRIVILALRLSDSGTYTCVIQKPVLKGAYKLEHLASVRLMIRADFPVPTINDLGNPSPNI | |
| SEQ:198_cd28F7-2 | (81) | GKVQVWPEYKNRTITDMNDNPRIVILALRLSDSGTYTCVIQKPVLKGAYKLEHLASVRLMIRADFPVPTINDLGNPSPNI | |
| SEQ:199_cd28F8-4 | (81) | GKVQVWPEYKNRTITDMNDNPRIVILALRLSDSGTYTCVIQKPDLKGAYKLEHLTSVRLMIRADFPVPSITDIGHPAPNV | |
| SEQ:200_cd28F10-2 | (81) | GKVQVWPEYKNRTITDMNDNPRIVILALRLSDSGTYTCVIQKPVLKGAYKLEHLASVRLMIRADFPVPSITDIGHPAPNV | |
| SEQ:201_cd28F12-5star | (81) | GKVQVWPEYKNRTITDMNDNPRIVILALRLSDSGTYTCVIQKPVLKGAYKLEHLASVRLMIRADFPVPTINDLGNPSPNI | |
| SEQ:202_cd28G2-8 | (81) | GKVQVWPEYKNRTPDIINNLSLMILALRLSDSGTYTCVIQKPVLKGAYKLEHLASVRLMIRADFPVPSINDLGNPSPNI | |
| SEQ:203_cd28G1-5 | (81) | GKVQVWPEYKNRTITDMNDNPRIVILALRLSDSGTYTCVVQK-NENGSFRREHLTSVTLSIRADFPVSSITDIGHPAPNV | |
| SEQ:204_cd28G1-9 | (81) | GKVQVWPEYKNRTITDMNDNPRIVILALRLSDKGTYTCVIQKPVLKGAYKLEHLASVRLMIRADFPVPSITDIGHPAPNV | |
| SEQ:205_cd28H4-3 | (81) | GKVQVWPEYKNRTITDMNDNPRIVILALRLSDSGTYTCVIQKPVLKGAYKLEHLASVRLMIRADFPVPTINDLGNPSPNI | |
| SEQ:206_cd28H11-3 | (81) | GKVQVWPEYKNRTITDMNDNPRIVILALRLSDSGTYTCVIQKPVLKGAYKLEHLASVRLMIRADFPVPTINDLGNPSPNI | |
| SEQ:207_cd28H6-6 | (81) | GKVQVWPEYKNRTITDMNDNPRIVILALRLSDKGTYTCVIQKPVLKGAYKLEHLASVRLMIRADFPVPTINDLGNPSPNI | |
| SEQ:208_cd28B2-4 | (81) | GKVQVWPEYKNRTITDMNDNPRIVILALRLSDSGTYTCVIQKPVLKGAYKLEHLASVRLMIRADFPVPTINDLGNPSPNI | |
| SEQ:209_cd28B4-5a | (81) | GKVQVWPEYKNRTITDMNDNPRIVILALRLSDKGTYTCVIQKPDLKGAYKLEHLASVRLMIRADFPVPSITDIGHPAPNV | |
| SEQ:210_cd28A2-5a | (81) | GKVQVWPEYKNRTITDMNDNPRIVILALRLSDKGTYTCVVQKPDLKGAYKLEHLTSVRLMIRADFPVPSITDIGHPAPNV | |
| SEQ:211_cd28B4-5star | (81) | GKVQVWPEYKNRTITDMNDNPRIVILALRLSDKGTYTCVVQK-NENGSFRREHLTSVTLSIRADFPVPSITDIGHPAPNV | |
| SEQ:212_cd28D5-6 | (81) | GKVQVWPEYKNRTITDMNDNPRIVILALRLSDKGTYTCVIQKPVLKGAYKLEHLTSVRLMIRADFPVPTINDLGNPSPNI | |
| SEQ:213_cd28D10-4 | (81) | GKVQVWPEYKNRTITDMNDNPRIVILALRLSDKGTYTCVVQKPDLKGAYKLEHLTSVRLMIRADFPVPSITDIGHPAPNV | |
| SEQ:214_cd28E2-5star | (81) | GKVQVWPEYKNRTITDMNDNPRIVILALRPSDSGTYTCVIQKPVLKGAYKLEHLASVRLMIRADFPVPTINDLGNPSPNI | |
| SEQ:215_cd28E5-2 | (81) | GKVQVWPEYKNRTITDMNDNPRIVILALRLSDKGTYTCVIQKPVLKGAYKLEHLASVRLMIRADFPVPTINDLGNPSPNI | |
| SEQ:216_cd28E8-6 | (81) | GKVQVWPEYKNRTITDMNDNPRIVILALRLSDSGTYTCVIQKPDLKGAYKLEHLASVRLMIRADFPVPTINDLGNPSPNI | |
| SEQ:217_cd28E9-6 | (81) | GKVQVWPEYKNRTITDMNDNPRIVILALRLSDKGTYTCVIQKPDLKGAYKLEHLASVRLMIRADFPVPTINDLGNPSPNI | |
| SEQ:218_cd28F3-1 | (81) | GKVQVWPEYKNRTITDMNDNPRIVILALRLSDSGTYTCVIQKPDLKGAYKLEHLTSVRLMIRADFPVPTINDLGNPSPNI | |
| SEQ:219_cd28F3-5 | (81) | GKVQVWPEYKNRTITDMNDNPRIVILALRLSDSGTYTCVVQK-NENGSFRREHLTSVTLSIRADFPVPSITDIGHPAPNV | |
| SEQ:220_cd28F3-6 | (81) | GKVQVWPEYKNRTITDMNDNPRIVILALRLSDSGTYTCVIQKPDLKGAYKLEHLTSVRLMIRADFPVPTINDLGNPSPNI | |
| SEQ:221_cd28F11-8 | (81) | GKVQVWPEYKNRTITDMNDNPRIVILALRLSDSGTYTCVIQKPVLKGAYKLEHLASVRLMIRADFPVPTINDLGNPSPNI | |
| SEQ:283_CD28BP_Con | (81) | GKVQVWPEYKNRTITDMNDNPRIVILALRLSDSGTYTCVIQKPVLKGAYKLEHLASVRLMIRADFPVPTINDLGNPSPNI | |

← Extracellular domain (ECD) →

Fig. 2D

| | | Extracellular domain (ECD) | |
|---|---|---|---|
| | 161 | | 240 |
| SEQ:278_Human_B7-1 | RRLICSTSGGFPEPHLSWLENGEELNAINTTVSQDPETELYAVSSKLDFNMTTNHSFMCLIKYGHLRVNQTFNWN-TKQE |
| SEQ:048_R1_Clone_71 | (158) RRLICSTSGGFPEPHLSWLENGEELNATNTTLSQDPETKLYMISSELDFNMTSNHSFLCLVKYGDLTVSQTFYWQESKPT |
| SEQ:049_R1_Clone_84 | (161) KRIRCSASGGFPEPRLAWMEDGEELNAVNTTVDQDLDTELYSVSSELDFNVTNNHSIVCLIKYGELSVSQIFPWSKPKQE |
| SEQ:050_R1_Clone_118 | (157) KRIRCSASGDFPEPRLAWMEDGEELNAVNTTVDQDLDTELYSVSSELDFNVTNNHSIVCLIKYGELSVSQIFPWSKPKQE |
| SEQ:051_R1_Clone_126 | (161) RRLICSTSGGFPRPHLYWLENGEELNATNTTVSQDPGTELYMISSELDFNVTNNHSIVCLIKYGELSVSQIFPWSKPKQE |
| SEQ:052_R2_CD28BP-1 | (161) RRLICSTSGGFPRPHLYWLENGEELNATNTTVSQDPGTELYMISSELDFNVTNNHSIVCLIKYGELSVSQIFPWSKPKQE |
| SEQ:053_R2_CD28BP-2 | (161) RRLICSTSGGFPRPHLYWLENGEELNATNTTLSQDPETKLYMISSELDFNVTNNHSIVCLIKYGELSVSQIFPWSKPKQE |
| SEQ:054_R2_CD28BP-3 | (161) RRLICSTSGGFPRPHLCWLENGEELNATNTTVSQDPGTELYMISSELDFNVTNNHSIVCLIKYGELSVSQIFPWSKPKQE |
| SEQ:055_R2_CD28BP-4 | (161) RRLICSTSGGFPRPHLYWLENGEELNATNTTVSQDPGTELYMISSELDFNVTNNHSIVCLIKYGELSVSQIFPWSKPKQE |
| SEQ:056_R2_CD28BP-5 | (161) RRLICSTSGGFPRPHLYWLENGEELNATNTTVSQDPGTELYMISSELDFNVTNNHSIVCLIKYGELSVSQIFPWSKPKQE |
| SEQ:057_R2_CD28BP-6 | (161) RRLICSTSGGFPRPHLYWLENGEELNATNTTVSQDPGTELYMISSELDFNVTNNHSIVCLIKYGELSVSQIFPWSKPKQE |
| SEQ:058_R2_CD28BP-7 | (161) RRLICSTSGGFPEPRLAWMEDGEELNAVNTTVDQDLDTELYSVSSELDSNVTNNHSIVCLIKYGELSVSQIFPWSKPKQE |
| SEQ:059_R2_CD28BP-8 | (161) RRLICSTSGGFPRPHLYWLENGEELNATNTTVSQDPGTELYMISSELDFNVTNNHSIVCLIKYGELSVSQIFPWSKPKQE |
| SEQ:060_R2_CD28BP-9 | (161) KRIRCSASGGFPEPRLAWMEDGEELNAVNTTVDQDLDTELYSVSSELDFNVTNNHSIVCLIKYGELSVSQIFPWSKPKQE |
| SEQ:061_R2_CD28BP-10 | (161) RRLICSTSGGFPRPHLYWLENGEELNATNTTVSQDPGTELYMISSELDFNVTNNHSIVCLIKYGELSVSQIFPWSKPKQE |
| SEQ:062_R2_CD28BP-11 | (161) RRLICSTSGGFPEPHLSWLENGEELNATNTTVSQDPGTELYMISSELDFNVTNNHSIVCLIKYGELSVSQIFPWSKPKQE |
| SEQ:063_R2_CD28BP-12 | (161) RRLICSTSGGFPRPHLYWLENGEELNATNTTVSQDPGTELYMISSELDFNVTNNHSIVCLIKYGELSVSQIFPWSKPKQE |
| SEQ:064_R2_CD28BP-13 | (161) RRLICSTSGGFPRPHLYWLENGEELNATNTTVSQDPGTELYMISSELDFNVTNNHSIVCLIKYGELSVSQIFPWSKPKQE |
| SEQ:065_R2_CD28BP-14 | (158) RRLICSTSGGFPEPRLAWMEDGEELNAVNTTVDQDLDTELYSVSSELDFNVTNNHSIVCLIKYGELSVSQIFPWSKPKQE |
| SEQ:066_R2_CD28BP-15 | (161) RRLICSTSGGFPRPHLYWLENGEELNATNTTVSQDPGTELYMISSELDFNVTNNHSIVCLIKYGELSVSQIFPWSKPKQE |
| SEQ:067_R2_CD28BP-16 | (160) KRIRCSASGGFPEPRLAWMEDGEELNAVNTTVDQDLDTELYSVSSELDFNVTNNHSIVCLIKYGELSVSQIFPWSKPKQE |
| SEQ:068_R2_CD28BP-17 | (161) RRLICSTSGGFPRPHLYWLENGEELNATNTTVDQLDTELYSVSSELDFNVTNNHSIVCLIKYGELLVSQIFPWSKPKQE |
| SEQ:174_cd28a12-5 | (161) RRLICSTSGGFPRPHLYWLENGEELNATNTTVSQDPETKLYMISSELDFNVTNNHSIVCLIKYGELSVSQIFPWSKPKQE |
| SEQ:175_cd28a4-5star | (161) RRLICSTSGGFPRPHLYWLENGEELNATNTTVSQDPGTELYMISSELDFNVTNNHSIVCLIKYGELSVSQIFPWSKPKQE |
| SEQ:176_cd28A4-9 | (161) RRLICSTSGGFPRPHLYWLENGEELNATNTTVSQDPETKLYMISSELDFNVTNNHSIVCLIKYGELSVSQIFPWSKPKQE |
| SEQ:177_cd28A6-9 | (161) RRLICSTSGGFPRPHLYWLENGEELNATNTTVSQDPGTELYMISSELDFNVTNNHSIVCLIKYGELSVSQIFPWSKPKQE |
| SEQ:178_cd28A6-1 | (161) RRLICSTSGGFPRPHLYWLENGEELNATNTTVSQDPETKLYMISSELDFNVTNNHSIVCLIKYGELSVSQIFPWSKPKQE |
| SEQ:179_cd28A8-4 | (161) RRLICSTSGGFPRPHLYWLENGEELNATNTTVDQLDTELYSVSSELDFNVTNNHSIVCLIKYGELSVSQIFPWSKPKQE |
| SEQ:180_cd28A8-6 | (160) RRLICSTSGGFPRPHLYWLENGEELNATNTTVSQDPGTELYMISSELDFNVTNNHSIVCLIKYGELSVSQIFPWSKPKQE |
| SEQ:181_cd28B2-8 | (161) RRLICSTSGGFPRPHLYWLENGEELNATNTTVSQDPETKLYMISSELDFNVTNNHSIVCLIKYGELSVSQIFPWSKPKQE |
| SEQ:182_cd28B4-3 | (161) RRLICSTSGGFPRPHLYWLENGEELNATNTTVDQLDTELYSVSSELDFNVTNNHSFLCLVKYGDLTVSQTFYWQESKPT |
| SEQ:183_cd28B6-3 | (161) RRLICSTSGGFPRPHLYWLENGEELNATNTTLSQDPETKLYMISSELDFNMTSNHSFLCLVKYGDLTVSQTFYWQESKPT |
| SEQ:184_cd28b6-6 | (161) RRLICSTSGGFPRPHLYWLENGEELNATNTTVSQDPGTELYMISSELDFNATNNHSIVCLIKYGELSVSQIFPWSKPKQE |
| SEQ:185_cd28b8-5star | (161) RRLICSTSGGFPEPRLAWMEDGEELNAVNTTVDQDLDTELYSVSSELDFNVTNNHSIVCLIKYGELSVSQIFPWSKPKQE |
| SEQ:186_cd28c11-5 | (161) RRLICSTSGGFPRPHLYWLENGEELNATNTTVSQDPGTELYMISSELDFNVTNNHSIACLIKYGELSVSQIFPWSKPKQE |

```
                    ECD ─────┤├──── TMD ────┤├──── CD ─────▶
                        241                                              307
SEQ:278_Human_B7-1  (238) HFPDNLLPSWAITL------ISVNGIFVICCLTYCFAPRCRERRNE-RLRRESVRPV------

SEQ:048_R1_Clone_71   (241) P-SANQHLTWTIIIPVSAFGISVIIAVILTCLTCRNAAIRRQRRENEVEMQSCSQSP------
SEQ:049_R1_Clone_84   (237) P-PIDQLPFWVIIP----VSGALVLTAVVLYCLACRHVARWKRTRRNEETVGTERLSPIYLGSAQSSG
SEQ:050_R1_Clone_118  (237) P-PIDQLPFWVIIP----VSGALVLTAVVLYCLACRHVARWKRTRRNEETVGTERLSPIYLGSAQSSG
SEQ:051_R1_Clone_126  (241) P-PIDQLPFWVIIP----VSGALVLTAVVLYCLACRHVARWKRTRRNEETVGTERLSPIYLGSAQSSG
SEQ:052_R2_CD28BP-1   (241) P-PIDQLPFWVIIP----VSGALVLTAVVLYCLACRHVARWKRTRRNEETVGTERLSPIYLGSAQSSG
SEQ:053_R2_CD28BP-2   (241) P-PIDQLPFWVIIP----VSGALVLTAVVLYRPACRHVARWKRTRRNEETVGTERLSPIYLGSAQSSG
SEQ:054_R2_CD28BP-3   (241) P-PIDQLPFWVIIP----VSGALVLTAVVLYCLACRHVARWKRTRRNEETVGTERLSPIYLGSAQSSG
SEQ:055_R2_CD28BP-4   (241) P-PIDQLPFWVIIP----VSGALVLTAVVLYCLACRHVARWKRTRRNEETVGTERLSPIYLGSAQSSG
SEQ:056_R2_CD28BP-5   (241) P-PIDQLPFWVIIP----VSGALVLTAVVLYCLACRHVARWKRTRRNEETVGTERLSPIYLGSAQSSG
SEQ:057_R2_CD28BP-6   (241) P-PIDQLPFWVIIP----VSGALVLTAVVLYCLACRHVARWKRTRRNEETVGTERLSPIYLGSAQSSG
SEQ:058_R2_CD28BP-7   (241) P-PIDQLPFWVIIP----VSGALVLTAVVLYCLACRHVARWKRTRRNEETVGTERLSPIYLGSAQSSG
SEQ:059_R2_CD28BP-8   (241) P-PIDQLPFWVIIP----VSGALVLTAVVLYCLACRHVARWKRTRRNEETVGTERLSPIYLGSAQSSG
SEQ:060_R2_CD28BP-9   (241) P-PIDQLPFWVIIP----VSGALVLTAVVLYCLACRHVARWKRTRRNEETVGTERLSPIYLGSAQSSG
SEQ:061_R2_CD28BP-10  (241) P-PIDQLPFWVIIP----VSGALVLTAVVLYCLACRHVARWKRTRRNEETVGTERLSPIYLGSAQSSG
SEQ:062_R2_CD28BP-11  (240) P-PIDQLPFWVIIP----VSGALVLTAVVLYCLACRHVARWKRTRRNEETVGTERLSPIYLGSAQSSG
SEQ:063_R2_CD28BP-12  (241) P-PIDQLPFWVIIP----VSGALVLTAVVLYCLACRHVARWKRTRRNEETVGTERLSPIYLGSAQSSG
SEQ:064_R2_CD28BP-13  (241) P-PIDQLPFWVIIP----VSGALVLTAVVLYCLACRHVARWKRTRRNEETVGTERLSPIYLGSAQSSG
SEQ:065_R2_CD28BP-14  (238) P-PIDQLPFWVIIP----VSGALVLTAAVVLTVVLYCLACRHVARWKRTRRNEETVGTERLSPIYLGSAQSSG
SEQ:066_R2_CD28BP-15  (241) P-PIDQLPFWVIIP----VSGALVLTAVVLYCLACRHVARWKRTRRNEETVGTERLSPIYLGSAQSSG
SEQ:067_R2_CD28BP-16  (241) P-PIDQLPFWVIIP----VSGALVLTAVVLYCLACRHVARWKRTRRNEETVGTERLSPIYLGSAQSSG
SEQ:068_R2_CD28BP-17  (240) P-PIDQLPFWVIIP----VSGALVLTAVVLYCLACRHVARWKRTRRNEETVGTERLSPIYLGSAQSSG
SEQ:174_cd28A12-5     (241) P-PIDQLPFWVIIP----VSGALVLTAVVLYCLACRHVARWKRTRRNEETVGTERLSPIYLGSAQSSG
SEQ:175_cd28a4-5star  (241) P-PIDQLPFWVIIP----VSGALVLTAVVLYCLACRHVARWKRTRRNEETVGTERLSPIYLGSAQSRAEVPSLSX
SEQ:176_cd28A4-9      (241) P-PIDQLPFWVIIP----VSGALVLTAVVLYCLACRHVARWKRTRRNEETVGTERLSPIYLGSAQSSG
SEQ:177_cd28A6-9      (241) P-PIDQLPFWVIIP----VSGALVLTAVVLYCLACRHVARWKRTRRNEETVGTERLSPIYLGSAQSSG
SEQ:178_cd28A6-1      (241) P-PIDQLPFWVIIP----VSGALVLTAIVLYCLACRHVARWKRTRRNEETVGTERLSPIYLGSAQSSG
SEQ:179_cd28A8-4      (241) P-PIDQLPFRVIIP----VSGALVLTAVVLYCLACRHVARWKRTRRNEETVGTERLSPIYLGSAQSSG
SEQ:180_cd28A8-6      (240) P-PIDQLPFWVIIP----VSGALVLTAVVLYCLACRHVARWKRTRRNEETVGTERLSPIYLGSAQSSG
SEQ:181_cd28B2-8      (241) P-PIDQLPFWVIIP----VSGALVLTAVVLYCLACRHVARWKRTRRNEETVGTERLSPIYLGSAQSSG
SEQ:182_cd28B4-3      (241) P-SANQHLTWTIIIPVSAFGISVIIAVILTCLTCRNAAIRRQRRENEVEMQSCSQSP------
SEQ:183_cd28B6-3      (241) P-SANQHLTWTIIIPVSAFGISVIIAVILTCLTCRNAAIRRQRRENEVKMQSCSQSP------
SEQ:184_cd28b6-6      (241) P-PIDQLPFWVIVP----VSGALVLTAVVLYCLACRHVAR--------
SEQ:185_cd28b8-5star  (241) P-PIDQLPFWVIIP----VSGALVLTAVVLYCLACRHVARWKRTRRNEETVGTERLSPIYLGSAQSSG
SEQ:186_cd28c11-5     (241) P-PIDQLPFWVIIP----VSGALVLTAVVLYCLACRHVARWKRTRRNEETVGTERLSPIYLGSAQSSG
```

```
                              ← Signal sequence →|← Extracellular domain (ECD) →
                            1                                                                              80
SEQ:278_Human_B7-1       (1) MGHTRRQGTSPSKCPYLKFFQLLVLAGLSHFCSGVIHVTKEVKEVATLSCGHNVSVEELAQTRIYWQKEKKMVLTMMSGD
SEQ:069_R1_CTLA4BP-5     (1) MGHTRRQGTSPSKCPYLKFFQLLVLAGLSHFCSGVIHVTKEVKEVATLSCGHNVSVEELAQTRIHWQKEKKMVLTMMYGD
SEQ:070_R1_CTLA4BP-7     (1) MGYTRRQGTSPSKCPYLKFFQLLVLAGLSHFCSGVIHVTNEVKEVATLSCGHNVSVEELAQTRIYWQKEKKMVLTMMSGD
SEQ:071_R1_CTLA4BP-11    (1) MSHTRRQGTSPSKCPYLKFFQLLVLASLSHFCSGVIHMTKEVKEVATLSCGHNVSVEELAQTRIYWQKEKKMVLTMMSGD
SEQ:072_R1_CTLA4BP-13    (1) MGHTRRQGISPSKCPYLKFFQLLVLVLACLSHFCSGVIHVTKEVKEVATLSCGHNVSVEELAQTRIYWQKEKKMVLTMMSGD
SEQ:073_R1_CTLA4BP-27    (1) MSHTRRQGISPSKCPYLNFFQLLVLACLSHFCSGVIHVTKEVKEVATLSCGLNVSVEELAQTRIYWQKEKKMVLTMMSGD
SEQ:074_R2_CTLA4BP-10c   (1) MGHTRRQGISPPKCPYLKFFQLLVLACLSHFCSGVIHVTKEVKEVATLSCGHNVSVEELAQTRIHWQKEKKMVLTMMSGD
SEQ:075_R2_CTLA4BP-11d   (1) MSHTRRQGISPSKCPYLKFFQLLVLACLSHFCSGVIHVTKEVKEVATLSCGHNVSVEELAQTRIHWQKEKKMVLTMMSGD
SEQ:076_R2_CTLA4BP-12F   (1) MSHTRRQGISPSKCPYLKFFQLLVLASLSHFCSGVIHVTKEVKEVATLSCGHNVSVEELAQTPIYWQKEKKMVLTMMSGD
SEQ:077_R2_CTLA4BP-2g    (1) MGHTRRQGTSPSKCPYLKFFQLLVLACLSHFCSGVIHVTKEVKEVATLSCGHNVSVEELAQTRIHWQKEKKMVLTMMSGD
SEQ:078_R2_CTLA4BP-3c    (1) MGYTRRQGTSPSKCPYLKFFQLLVLACLSHLCSGVIHVTKEVKEVATLSCGHNVSVEELAQTRIHWQKEKKMVLTMMSGD
SEQ:079_R2_CTLA4BP-4c    (1) MSHTRRQGTSPSKCPYLNFFRLLVLASLSHFCSGVIHVTREVKEVATLSCGLNVSVEELAQTRIHWQKEKKMVLTMMSGD
SEQ:080_R2_CTLA4BP-7b    (1) MSHTRRQGISPSKCPYLNFFQLLVLASLSHFCSGVIHVTKEVKEVATLSCGLNVSVEELAQTRIHWQKEKKMVLTMMSGD
SEQ:081_R2_CTLA4BP-8c    (1) MSHTRRQGTSPSKCPYLKFFQLLVLACLSHFCSGVIHMTKEVKEVATLSCGHNVSVEELAQTRIYWQKEKKMVLTMMSGD
SEQ:082_R2_CTLA4BP-10e   (1) MGYTRRQGISPSKCPYLKFFQLLVLACLSHFCSGVIHVTKEVKEVATLSCGHNVSVEELAQTRIYWQKEKKMVLTMMSGD
SEQ:083_R2_CTLA4BP-11b   (1) MSHTRRQGISPSKCPYLKFFQLLVLACLSHFCSGVIHVTKEVKEVATLSCGHNVSVEELAQTRIYWQKGKKMVLTMMSGD
SEQ:084_R2_CTLA4BP-6f    (1) MGHTRRQGISPSKCPYLKFFQLLVLACLSHFCSGVIHVTKEVKEVATLSCGHNVSVEELAQTRIYWQKEKKMVLTMMSGD
SEQ:085_R2_CTLA4BP-11d   (1) MGHTRRQGISPSKCPYLKFFQLLVLACLSHFCSGVIHVTKEVKEVATLSCGHNVSVEELAQTRIHWQKEKKMVLTMMSGD
SEQ:086_R2_CTLA4BP-12c   (1) MGHTRRQGISPSKCPYLKFFQLLVMACLSHFCSGVIHVTKEVKEVATLSCGHNVSVEELAQTRIHWQKEKKMVLTMMSGD
SEQ:087_R2_CTLA4BP-1f    (1) MGHTRRQGISPSKCPYLKFFQLLVLAGLPHLCSGVIHVTKEVKEVATLSCGHNVSVEELAQTRIHWQKEKKMVLTMMSGD
SEQ:088_R2_CTLA4BP-2e    (1) MGHTRRQGISPSKCPYLKFFQLLVLAGLSHLCSGVIHVTKEVKEVATLSCGHNVSVEELAQTRIHWQKEKKMVLTMMSGD
SEQ:089_R2_CTLA4BP-6e    (1) MSHTRRQGISPSKCPYLKFFQLLVLAGLSHFCSGVIHVTKEVKEVATLSCGHNVSVEELAQTRIHWQKEKKMVLTMMSGD
SEQ:090_R2_CTLA4BP-9d    (1) MGHTRRQGISPSKCPYLKFFQLLVLAGLSHFCSGVIHVTKEVKEVATLSCGHNVSVEELAQTRIHWQKEKKMVLTMMSGD
SEQ:091_R2_CTLA4BP-1f    (1) MGHTRRQGTSPSKCPYINFFQLLVLACLSHFCSGVIHVTKEVKEVATLSCGHNVSVEELAQTRIHWQKEKKMVLTMMSGD
SEQ:092_R2_CTLA4BP-12c   (1) MGYTRRQGTSPSKCPYLKFFQLLVLASLSHFCSGVIHVTKVKEVATLSCGHNVSVEELAQTPIYWQKEKKMVLTMMSGD
SEQ:222_ctla5x9d10       (1) MSHTRRQGISPSKCPYLNFFQLLVIASLSHFCSGVIHVTKEVKEVATLSCGHNVSVEELAQTRIHWQKEKKMVLTMMSGD
SEQ:223_ctla5x6f6        (1) MGYTRRQGTSPSKCPYLKFFQLLVIASLSHFCSGVIHVTKKVKEVATLSCGHNVSVEELAQTPIYWQKEKKMVLTMMSGD
SEQ:224_ctla5x5h12       (1) MSHTRRQGISPSKCPYLKFFQLLVLASLSHFCSGVIHVTKEVKEVATLSCGHNVSVEELAQTRIHWQKEKKMVLTMMSGD
SEQ:225_ctla5x5c10       (1) MSHTQRQGISPSKCPYLNFFQLLVLASLSHFCSGVIHVTKEVKEVATLSCGHNVSVEELAQTRIHWQKEKKMVLTMMSGD
```

Fig. 3B

| SEQ ID | Signal sequence / Extracellular domain (ECD) |
|---|---|
| SEQ:226_ctla5x3e8 | MGHTRRQGTSPSKCPYLKFFQLLVLAGLSHLCSGVIHVTKEVKEVATLSCGHNVSVEELAQTRIYWQKEKKMVLTMMSGD |
| SEQ:227_ctla5x3c4 | MSHIRRQGISPSKCPYLNFFQLLVLASLSHFCSGVIHVTKEVKEVATLSCGHNVSVEELAQTRIYWQKEKKMVLTMMSGD |
| SEQ:228_ctla5x3c3 | MSHTRRQGTSPSKCPYLKFFQLLVLASLSHFCSGVIHMTKEVKEVATLSCGPNVSVEELAQTRIYWQKEKKMVLTMMSGD |
| SEQ:229_ctla5x2h11 | MSHTRRQGISSSKCPYLKFFQLLVLACLSHFCSGVIHVTKKVKEVATLSCGHNVSVEELAQTRIYWQKGKKMVLTMMSGD |
| SEQ:230_ctla5x2d7 | MGYTRRQGTSPSECPYLKFFQLLVLAGLSHFCSGVIHMTKEVKEVATLSCGHNVSVEELAQTRIHWQKEKKMVLTMMSGD |
| SEQ:231_ctla5x2b7 | MSHTRRQGISPSKCPYLNFFRLLVLASLSHFCSGVIHVTKEVKEVATLSCGLNVSVEELAQTRIHWQKEKKMVLTMMSGD |
| SEQ:232_ctla5x2b1 ns | MGHTRRQGISPSKCPYLKFFQLLVLASLSHFCSGVIHVTKEVKEVATLSCGHNVSVEELAQTRIHWQKEKKMVLTMMSGD |
| SEQ:233_ctla5x1f1 | MGHTRRQGISPSKCPYLKFFQLLVLASLSHFCSGVIHVTKEVKEVATLSCGLNVSVEELAQTRIYWQKEKKMVLTMMSGD |
| SEQ:234_ctla5x1d7 | MGYTRRQGISPSKCPYLNFFQLLVLACLSHFCSGVIHVTKEVKEVATLSCGHNVPVEELAQTRIYWQKDKKMVLTMMSGD |
| SEQ:235_ctla2x4g9 | MGHTRRQGTSPSKCPYLKFFQLLVLAGLSHFCSGVIHVTKEVKEVATLSCGHNVSVEELAQTRIHWQKEKKMVLTMMSGD |
| SEQ:236_ctla2x4a6 | MGYTRRQGTSPSKCPYLKFFQLLVLACLSHFCSGVIHMTKEVKEVATLSCGLNVSVEELAQTRIYWQKEKKMVLTMMSGD |
| SEQ:237_ctla2x2f3 | MGHTRRQGISPSKCPYLKFFQLLVLACLSHFCSGVIYVTKEVKEVATLSCGHNVSVEELAQTRIYWQKEKKMVLTMMSGD |
| SEQ:238_ctla2x2f12 | MGYTRRQGTSPSKCPYLKFFQLLVLAGLSHFCSGVIHVTKEVKEVATLSCGHNVSVEELAQTRIHWQKEKKMVLTMMSGD |
| SEQ:239_ctla2x1g8 | MGYTRRQGTSPSKCPYLNFFQLLVLVLASLSHFCSGVIHVTKEVKEVATLSCGHNVSVEELAQTRIHWQKEKKMVLTMMSGD |
| SEQ:240_ctla2x1f10 | MGYTRRQGISPSKCPYLKFFQLLVLAGLSHFCSGVIHVTKEVKEVATLSCGHNVSABELAQTRIHWQKEKKMVLTMMSGD |
| SEQ:241_ctla2x1c9 | MSHTRRQGISPSKCPYLKFFQLLVLAGLSHFCSGVIHVTKEVKEVATLSCGLNVSVEELAQTRIHWQKEKKMVLTMMSGD |
| SEQ:242_ctla2x1h12 | MGHTRRQGTSPSKCPYLKFFQLLVLAGLSHFCSGVIHVTKEVKEVATLSCGHNVSDEELAQTRIHWQKEKKMVLTMMSGD |
| SEQ:243_ctla2x1e2 | MGYTRRQGISPSKCPYLKFFQLLVLAGLSHFCSGVIHVTKEVKEVATLPCGHNVSVEELAQTRIHWQKEKKMVLTMMSGD |
| SEQ:244_ctla2x1c4 | MGYTRRQGISPSKCPYLKFFQLLVLAGLSHLCSGVIHMTKEVKEVATLSCGHNVSVEELAQTRIYWQKEKKMVLTMMSGD |
| SEQ:245_ctla2x1b12 | MGHTRRQGISPSKCPYLKFFQLLGLACLSHFCSGVIHVTKEVKEVATLSCGHNVSVEELAQTRIHWQKEKKMVLTMMSGD |
| SEQ:246_ctla2x2f1 | MGHTRRQGTSPSKCPYLKFFQLLVLAGLSHFCSGVIHVTKEVKEVATLSCGHNVSVEELAQTRIHWQKEKKMVLTMMSGD |
| SEQ:247_ctla5x4h1 | MSHTRRQGISPSKCPYLKFFQLLVLAGLSHFCSGVIHVTKEVKEVATLSCGHNVSVEELAQTRIYWQKEKKMVLTMMSGD |
| SEQ:248_ctla5x4a1 | MGHTRRQGTSPSKCPYLKFFQLLVLASLSHFCSGVIHVTKEVKEVATLSCGHNVSVEELAQTRIYWQKEKKMVLTMMPGD |
| SEQ:249_ctla5x2f3 | MSHTRRQGISPSKCPYLKFFQLLVLAGLSHFCSGVIHVTKEVKEVATLSCGHNVSVEELAQTRIHWQKEKKMVLTMMSGD |
| SEQ:250_ctla5x2e12 | MSHTRRQGISPSKCPYLKFFQLLVLAGLSHFCSGVIHVTKEVKEVATLSCGHNVSVEELAQTRIHWQKEKKMVLTMMSGG |
| SEQ:251_ctla2x4h11 | MGYTRRQGTSPSKCPYLKFFQLLVLACLSHFCSGVIHVTKEVKEVATLSCGHNVSVEELAQTRIHWQKEKKMVLTMMSGD |
| SEQ:252_ctla2x3h2 | MGHTRRQGTSPSKCPYLKFFQLLVLACLSHFCSGVIHVTKEVKEVATLSCGHNVSVEELAQTRIHWQKEKKMVLTMMSGD |
| SEQ:286_CTLA4BP_Con | MGHTRRQGISPSKCPYLKFFQLLVLACLSHFCSGVIHVTKEVKEVATLSCGHNVSVEELAQTRIHWQKEKKMVLTMMSGD |

Fig. 3C

Extracellular domain (ECD)

| | | 81 | | 160 |
|---|---|---|---|---|
| SEQ:278_Human_B7-1 | | MNIWPEYKNRTIFDITNNLSIVILALRPSDEGTYECVVLKYEKDAFKREHLAEVTLSVKADFPTPSISDFEIPPSNIRRI | |
| SEQ:069_R1_CTLA4BP-5 | (81) | MNIWPEYKNRTIFDITNNLSIVILALRPSDEGTYECVVLKYEKDAFKREHLAEVTLSVKADFPTPSISDFEIPPSNIRRI | |
| SEQ:070_R1_CTLA4BP-7 | (81) | MNIWPEYKNRTIFDITNNLSIVILALRPSDEGTYECVVLKYEKDAFKREHLAEVMLSVKADFPTPSITDFEIPPSNIRRI | |
| SEQ:071_R1_CTLA4BP-11 | (81) | MNIWPEYKNRTIFDITNNLSIVILALRPSDEGTYECVVLKYEKDAFKREHLAEVMLSVKADFPTPSITDFEIPPSNIRRI | |
| SEQ:072_R1_CTLA4BP-13 | (81) | MNIWPEYKNRTIFDITNNLSIVILALRPSDEGTYECVVLKYEKDAFKREHLAEVMLSVKADFPTPSITDFEIPPSNIRRI | |
| SEQ:073_R1_CTLA4BP-27 | (81) | MNIWPEYKNRTIFDITNNLSIVILALRPSDEGTYECVVLKYEKDAFKREHLAEVMLSVKADFPTPSITDFEIPPSNIRRI | |
| SEQ:074_R2_CTLA4BP-5x2-10c | (81) | MNIWPEYKNRTIFDITNNLSIVILALRPSDEGTYECVVLKYEKDAFKREHLAEVMLSVKADFPTPSISDFEIPPSNIRRI | |
| SEQ:075_R2_CTLA4BP-5x2-11d | (81) | MNIWPEYKNRTIFDITNNLSIVILALRPSDEGTYECVVLKYEKDAFKREHLAEVMLSVKADFPTPSITDFEIPPSNIRRI | |
| SEQ:076_R2_CTLA4BP-5x2-12f | (81) | MNIWPEYKNRTIFDITNNLSIVILALRPSDEGTYECVVLKYEKDAFKREHLAEVTLSVKADFPTPSISDFEIPTSNIRRI | |
| SEQ:077_R2_CTLA4BP-5x2-2g | (81) | MNIWPEYKNRTIFDITNNLSIVILALRPSDEGTYECVVLKYEKDAFKREHLAEVMLSVKADFPTPSITDFEIPPSNIRRI | |
| SEQ:078_R2_CTLA4BP-5x2-3c | (81) | MNIWPEYKNRTIFDITNNLSIVILALRPSDEGTYECVVLKYEKDAFKREHLAEVMLSVKADFPTPSITDFEIPPSNIRRI | |
| SEQ:079_R2_CTLA4BP-5x2-4c | (81) | MNIWPEYKNRTIFDITNNLSIVILALRPSDEGTYECVVLKYEKDAFKREHLAEVMLSVKADFPTPSISDFEIPPSNIRRI | |
| SEQ:080_R2_CTLA4BP-5x2-7b | (81) | MNIWPEYKNRTIFDITNNLSIVILALRPSDEGTYECVVLEYEKDAFKREHLAEVMLSVKADFPTPSITDFEIPPSNIRRI | |
| SEQ:081_R2_CTLA4BP-5x2-8c | (81) | MNIWPEYKNRTIFDITNNLSIVILALRPSDEGTYECVVLKYEKDAFKQEHLAEVMLSVKADFPTPSITDFEIPPSNIRRI | |
| SEQ:082_R2_CTLA4BP-5x3-10e | (81) | MNIWPEYKNRTIFDITNNLSIVILALRPSDEGTYECVVLEYEKDAFKREHLAEVTLSVKADFPTPSITDFEIPPSNIRRI | |
| SEQ:083_R2_CTLA4BP-5x3-11b | (81) | MNIWPEYKNRTIFDITNNLSIVILALRSSDEGTYECVVLKYEKDAFKREHLAEVMLSVKADFPTPSITDFEIPTSNIRRI | |
| SEQ:084_R2_CTLA4BP-5x3-6f | (81) | MNIWPEYKNRTIFDITNNLSIVILALRPSDEGTYECVVLKYEKDAFKREHLAEVMLSVKADFPTPSITDFEIPPSNIRRI | |
| SEQ:085_R2_CTLA4BP-5x4-11d | (81) | MNIWPEYKNRTIFDITNNLSIVILALRPSDEGTYECVVLKYEKDKDAFKREHLAEVMLSVKADFPTPSISDFEIPPSNIRRI | |
| SEQ:086_R2_CTLA4BP-5x4-12c | (81) | MNIWPEYKNRTIFDITNNLSIVILALRPSDEGTYECVVLKYEKDAFKREHLAEVMLSVKADFPTPSISDFEIPPSNIRRI | |
| SEQ:087_R2_CTLA4BP-5x4-1f | (81) | MNIWPEYKNRTIFDITNNLSIVILALRPSDEGTYECVVLKYEKDAFKREHLAEVMLSVKADFPTPSISDFEIPPSNIRRI | |
| SEQ:088_R2_CTLA4BP-5x5-2e | (81) | MNIWPEYKNRTIFDITNNLSIVILALRPSDEGTYECVVLKYEKDAFKREHLAEVMLSVKADFPTPSISDFEIPPSNIRRI | |
| SEQ:089_R2_CTLA4BP-5x5-6e | (81) | MNIWPEYKNRTIFDITNNLSIVILALRPSDEGTYECVVLKYEKDAFKREHLAEVMLSVKADFPTPSISDFEIPPSNIRRI | |
| SEQ:090_R2_CTLA4BP-5x6-9d | (81) | MNIWPEYKNRTIFDITNNLSIVILALRPSDEGTYECVVLKYEKDAFKREHLAEVMLSVKADFPTPSISDFEIPPSNIRRI | |
| SEQ:091_R2_CTLA4BP-5x8-1f | (81) | MNIWPEYKNRTIFDITNNLSIVILALRPSDEGTYECVVLKYEKDAFKREHLAEVMLSVKADFPTPSITDFEIPPSNIRRI | |
| SEQ:092_R2_CTLA4BP-5x9-12c | (81) | MNIWPEYKNRTIFDITNNLSIVILALRPSDEGTYECVVLEYEKDAFKREHLAEVMLSVKADFPTPSITDFEIPPSNIRRI | |
| SEQ:222_ctla5x9d10 | (81) | MNIWPEYKNRTIFDITNNLSIVILALRPSDEGTYECVVLKYEKDAFKREHLAEVMLSVKADFPTPSISDFEIPPSNIRRI | |
| SEQ:223_ctla5x6f6 | (81) | MNIWPEYKNRTIFDITNNLSIVILALRPSDEGTYECVVLKYEKDAFKREHLAEVMLSVKAGFPTPSISDFEIPPSNIRRI | |
| SEQ:224_ctla5x5h12 | (81) | MNIWPEYKNRTIFDITNNLSIVILALRPSDEGTYECVVLEYEKDAFKREHLAEVMLSVKADFPTPSITDFEIPPSNIRRI | |
| SEQ:225_ctla5x5c10 | (81) | MNIWPEYKNRTIFDITNNLSIVILALRPSDEGTYECVVLEYEKDAFKREHLAEVMLSVKADFPTPSITDFEIPPSNIRRI | |

← Extracellular domain (ECD) →

```
                        81                                                                                    160
SEQ:226_ctla5x3e8    (81) MNIWPEYKNRTIFDITNNLSIVILALRPSDEGTYECVVLKYEKDAFKREHLAEVTLSVKADFPTPSISDFEIPTSNIRRI
SEQ:227_ctla5x3c4    (81) MNIWPEYKNRTIFDITNNLSIVILALRPSDEGTYECVVLKYEKDAFKREHLAEVTLSVKADFPTPSISDFEIPTSNIRRI
SEQ:228_ctla5x3c3    (81) MNIWPEYKNRTIFDITNNLSIVILALRPSDEGTYECVVLKYEKDAFKREHLAEVTLSVKADFPTPSISDFEIPTSNIRRI
SEQ:229_ctla5x2h11   (81) MNIWPECKNRTIFDITNNLSIVILALRPSDEGTYECAVLKYEKDAFKREHLAEVTLSVKADFPTPSISDFEIPTSNIRRI
SEQ:230_ctla5x2d7    (81) MNIWPEYKNRTIFDITNNLSIVILALRPSDEGTYECVVLKYEKDAFKREHLAEVMLSVKADFPTPSISDFEIPPSNIRRI
SEQ:231_ctla5x2b7    (81) MNIWPEYKNRTIFDITNNLSIVILALRPSDEGTYECVVLKYEKDAFKREHLAEVTLSVKADFPTPSITDFEIPPSNIRRI
SEQ:232_ctla5x2b1 ns (81) MNIWPEHKNRTIFDITNNLSIVILALRPSDEGTYECVVLKYEKDAFKREHLAEVTLSVKADFPTPSITDFEIPPSNIRRI
SEQ:233_ctla5x1f1    (81) MNIWPEHKNRTIFDITNNLSIVILALRPSDEGTYECVVLKYEKDAFKREHLAEVTLSVKADFPTPSITDLEIPPSNIRRI
SEQ:234_ctla5x1d7    (81) MNIWPEYKNRTIFDITNNLSIVILALRPSDEGTYGCVVLKYEKDAFKREHLAEVMLSVKADFPTPSISDFEIPPSNIRRI
SEQ:235_ctla2x4g9    (81) MNIWPEYKNQTIFDITNNLSIVILALRPSDEGTYECVVLKYEKDAFKQEHLAEVMLSVKADFPTPSISDFEIPPSNIRRI
SEQ:236_ctla2x4a6    (81) MNIWPEYKNRTIFDITNNLSIVILALRPSDEGTYECVVLKYEKDAFKREHLAEVMLSVKADFPTPSISDFEIPPSNIRRI
SEQ:237_ctla2x2f3    (81) MNIWPEYKNRTIFDITNNLSIVILALRPSDEGT-ECVVLKYEKDAFKREHLAEVMLSVKADFPTPSISDFEIPPSNIRRI
SEQ:238_ctla2x2f12   (81) MNIWPEYKNRTIFDITNNLSIVILALRPSDEGTYGCVVLKYEKDAFKREHLAEVMLSVKADFPTPSISDFEIPPSNIRRI
SEQ:239_ctla2x1g8    (81) MNIWPEYKNRTIFDITNNLSVVILALRPSDEGTYECVVLKYEKDAFKREHLAEVTLSVKADFPTPSITDFEIPPSNIRRI
SEQ:240_ctla2x1f10   (81) MNIWPEYKNRTIFDITNNLSIVILALRPSDEGTYECVVLKYEKDAFKREHLAEVTLSVKADFPTPSITDFEIPPSNIRRI
SEQ:241_ctla2x1c9    (81) MNIWPEYKNRTIFDITNNLSIVILALRPSDEGTYECVVLKYEKDAFKREHLAEVMLSVKADFPTPSITDFEIPPSNIRRI
SEQ:242_ctla2x1h12   (81) MNIWPEYKNRTIFDITNNLSIVILALRPSDEGTYECVVLKYEKDAFKREHLAEVTLSVKADFPTPSISDFEIPPSNIRRI
SEQ:243_ctla2x1e2    (81) MNIWPEYKNRTIFDITNNLSIVILALRPSDEGTYECVVLKYEKDAFKREHLAEVTLSVKADFPTPSISDFEIPPSNIRRI
SEQ:244_ctla2x1c4    (81) MNIWPEYKNRTIFDITNNLSIVILALRPSDEGTYECVALKYEKDAFKQEHLAEVMLSVKADFPTPSITDFEIPPSNIRRI
SEQ:245_ctla2x1b12   (81) MNIWPEYKNRTIFDITNNLSIVILALSLRPSDEGTYECVVLKYEKDAFKREHLAEVTLSVKADFPTPSISDFEIPPSNIRRI
SEQ:246_ctla2x2f1    (81) MNIWPEYKNRTIFDITNNLSIVILALRPSDEGTYECVVLKYEKDAFKREHLAEVTLSVKADFPTPSISDFEIPPSNIRRI
SEQ:247_ctla5x4h1    (81) MNIWPEHKNRTIFDITNNLSIVILALRPSDEGTYECVVLKYEKDAFKRKHLAEVTLSVKADFPTPSITDFEIPPSNIRRI
SEQ:248_ctla5x4a1    (81) MNIWPEYKNRTIFDITNNLSIVILALRPSDEGTYECVVLKYEKDAFKREHLAEVTLSVKADFPTPSITDFEIPPSNIRRI
SEQ:249_ctla5x2f3    (81) MNIWPEYKNRTIFDITNNLSIVILALRPSDEGTYECVVLKYEKDAFKREHLAEVTLSVKADFPTPSITDFEIPPSNIRRI
SEQ:250_ctla5x2e12   (81) MNIWPEYKNRTIFDITNNLSIVILALRPSDEGTYECVVLRYEKDAFKREHLAEVTLSVKADFPTPSISDFEIPPSNIRRI
SEQ:251_ctla2x4h11   (81) MNIWPEYKNRTIFDITNNLSIVILALRPSDEGTYECVVLKYEKDAFKREHLAEVMLSVKADFPTPSISDFEIPPSNIRRI
SEQ:252_ctla2x3h2    (81) MNIWPEYKNRTIFDITNNLSIVILALRPSDEGTYECVVLKYEKDAFKREHLAEVMLSVKADFPTPSISDFEIPPSNIRRI
SEQ:286_CTLA4BP_Con  (81) MNIWPEYKNRTIFDITNNLSIVILALRPSDEGTYECVVLKYEKDAFKREHLAEVMLSVKADFPTPSISDFEIPPSNIRRI
```

Extracellular domain (ECD) →

```
                              161                                                                                           240
SEQ:278_Human_B7-1      (161) ICSTSGGFPEPHLSWLENGEELNAINTTVSQDPETELYAVSSKLDFNMTTNHSFMCLIKYGHLRVNQTFNWNTTKQEHFP
SEQ:069_R1_CTLA4BP-5    (161) ICSTSGGFPEPHLSWLENGEELNAINTTVSQDPGTELYTVSSKLDFNMTTNHSFMCLIKYGHLRVNQTFSWNTPKQEHFP
SEQ:070_R1_CTLA4BP-7    (161) ICLTSGGFPEPRLAWMKDGEELNAISTTVSQDPGTELYAVSSKLDFNMTTNHSFMCLIKYGHLRVNQTFSWNTPKQEHFP
SEQ:071_R1_CTLA4BP-11   (161) ICSTSGGFPEPHLFWLENGEELNAINTTVSQDPETELYTVSSKLDFNMTPNRSFVCLIKYGHLRVNQTFNWNTPKQEHFP
SEQ:072_R1_CTLA4BP-13   (161) ICSTSGGFPEPHLFGLENGEEINAINTTASQDPETELYTVSSKLDFNMTANHSFVCLIKYGHLRVNQTFNWNTPKQEHFP
SEQ:073_R1_CTLA4BP-27   (161) ICSTSGGFPEPHLSWLENGEELNAINTTVSQDPETELYTVSSKLDFNMTANHSFVCLIKYGHLRVNQTFNWNTPKQEHFP
SEQ:074_R2_CTLA4BP-5x2-10c (161) ICSTSGGFPEPHLSWLENGEELNAINTTVSQDPETELYTVSSKLDFNMTTDRSFVCLIKYGHLRVNQTFNWNTPKQEHFP
SEQ:075_R2_CTLA4BP-5x2-11d (161) ICSTSGGFPEPHLSWLENGEELNAINTTVSQDPETELYTVSSKLDFNMTTNHSFMCLIKYGHLRVNQTFNWNTPKQEHFP
SEQ:076_R2_CTLA4BP-5x2-12F (161) ICSTSGGFPEPHLSWLENGEELNAINTTVSQDPETGLYTVSSKLDFNMTANHSFVCLIKYGHLRVNQTFNWNTPKQEHFP
SEQ:077_R2_CTLA4BP-5x2-2g (161) ICSTSGGFPEPHLSWLENGEELNGINTTVSQDPETELYTVSSKLDFNMTANHSFVCLIKYGHLRVNQTFNWNTPKQEHFP
SEQ:078_R2_CTLA4BP-5x2-3c (161) ICSTSGGFPEPHLSWLENGEELNAINTTVSQDPETELYTVSSKLDFNMTANHSFVCLIKYGHLRVNQTFNWNTPKQEHFP
SEQ:079_R2_CTLA4BP-5x2-4c (161) ICSTSGGFPEPHLSWLENGEELNAINTTVSQDPETELYTVSSKLDFNMTANHSFVCLIKYGHLRVNQTFNWNTPKQEHFP
SEQ:080_R2_CTLA4BP-5x2-7b (161) ICSTSGGFPEPHLSWLENGEELNAINTTVSQDPETELYTVSSKLDFNMTTNHSFVCLIKYGHLRVNQTFNWNTPKQEHFP
SEQ:081_R2_CTLA4BP-5x2-8c (161) ICSTSGGFPEPHLSWLENGEELNAINTTVSQDPETELYTVSSKLDFNMTTNHSFVCLIKYGHLRVNQTFNWNTPKQEHFP
SEQ:082_R2_CTLA4BP-5x3-10e (161) ICSTSGGFPEPHLSWLENGEELNAINTTVSQDPETELYTVSSKLDFNMTANHSFVCLIKYGHLRVNQTFNWNTPKQEHFP
SEQ:083_R2_CTLA4BP-5x3-11b (161) ICSTSGGFPEPHLSWLENGEELNAINTTVSQDPETELYTVSSKLDFNMTTNHSFVCLIKYGHLRVNQTFNWNTPKQEHFP
SEQ:084_R2_CTLA4BP-5x3-6f (161) ICSTSGGFPEPHLSWLENGEELNAINTTVSQDPETELYTVSSKLDFNMTTNHSFVCLIKYGHLRVNQTFNWNTPKQEHFP
SEQ:085_R2_CTLA4BP-5x4-11d (161) ICSTSGGFPEPHLSWLENGEELNAINTTASQDPETELYTVSSKLDFNMTANHSFVCLIKYGHLRVNQTFNWNTPKQEHFP
SEQ:086_R2_CTLA4BP-5x4-12c (161) ICSTSGGFPEPHLFWLENGEELNAINTTVSQDPETELYTVSSKLDFNMTTNHSFMCLIKYGHLRVNQTFNWNTPKQEHFP
SEQ:087_R2_CTLA4BP-5x4-14 (161) ICSTSGGFPEPHLFWLENGEELNAINTTVSQDPETELYTVSSKLDFNMTTNHSFMCLIKYGHLRVNQTFNWNTPKQEHFP
SEQ:088_R2_CTLA4BP-5x5-2e (161) ICSTSGGFPEPHLSWLENGEELNAINTTVSQDPETELYTVSSKLDFNMTTNHSFMCLIKYGHLRVNQTFNWNTPKQEHFP
SEQ:089_R2_CTLA4BP-5x5-6e (161) ICSTSGGFPEPHLSWLENGEELNAINTTVSQDPETELYTVSSKLDFNMTTNHSFVCLIKYGHLRVNQTFNWNTPKQEHFP
SEQ:090_R2_CTLA4BP-5x6-9d (161) ICSTSGGFPEPHLSWLENGEELNAINTTASQDPETELYTVSSKLDFNMTTNHSFVCLIRYGHLRVNQTFNWNTPKQEHFP
SEQ:091_R2_CTLA4BP-5x8-1f (161) ICSASGGFPEPHLFWLENGEELNAISTTVSQDPETELYTVSSKLDFNMTTNHSFVCLIKYGHLRVNQTFNWNTPKQEHFP
SEQ:092_R2_CTLA4BP-5x9-12c (161) ICSTSGGFPEPHLSWLENGEELNAINTTVSQDPGTELYTVSSKLDFNMTTNHSFVCLIKYGHLRVNQTFNWNTPKQEHFP
SEQ:222_ctla5x9d10       (161) ICSTSGGFPEPHLSWLENGEELNAINTTVSQDPETELYTVSSKLDFNMTTDRSFVCLIKYGHLRVNQTFNWNTPKQEHFP
SEQ:223_ctla5x6f6        (161) ICSTSGGFPEPHLSWLENGEELNAISTTVSQDPGTELYTVSSKLDFNMTTNHSFVCLIKYGHLRVNQTFNWNTPKQEHFP
SEQ:224_ctla5x5h12       (161) ICSTSGGFPEPHLSWLENGEELNAINTTVSQDPGTELYTVSSKLDFNMTTNHSFVCLIKYGHLRVNQTFNWNTPKQEHFP
SEQ:225_ctla5x5c10       (161) ICSTSGGFPEPHLSWLENGEELNAINTTVSQDPETELYTVSSKLDFNMTTNHSFMCLIKYGHLRVNQTFNWNTPKQEHFP
```

Fig. 3F

◄──────── Extracellular domain (ECD) ────────►

```
                              161                                                                                           240
SEQ:226_ctla5x3e8      (161) ICSTSGGFPEPHLFWLENGEELNAINTTVSQDPETELYTVSSKLDFNMTANHSFVCLIKYGHLRVNQTFNMNTPKQEHFP
SEQ:227_ctla5x3c4      (161) ICSTSGGFPEPRLAWMEDGEELNAINTTASQDPETELYTVSSKLDFNMTTNRSFVCLIKYGHLRVNQTFNMNTPKQEHFP
SEQ:228_ctla5x3c3      (161) ICSTSGGFPEPHLSWLENGEELNAINTTVSQDPGTELYTVSSKLDFNMTTNHSFMCLIKYGHLRVNQTFNMNTPKQEHFP
SEQ:229_ctla5x2h11     (161) ICSTSGGFPEPHLFWLENGEELNAINTTASQDPETELYAVSSKLDFNMTTNHSFMCLIKYGHLRVNQTFNMNTPKQEHFP
SEQ:230_ctla5x2d7      (161) ICSTSGGFPEPHLFWLENGEELNAINTTVSQDPETGLYTVSSKLDFNMTTNHSFMCLIKYGHLRVNQTFNMNTPKQEHFP
SEQ:231_ctla5x2b7      (161) ICSTSGGFPEPHLFWLENGEELNAINTTVSQDPGTELYTVSSKLDFNMTANHSFVCLIKYGHLRVNQTFNMNTPKQEHFP
SEQ:232_ctla5x2b1_ns   (161) ICSTSGGFPEPHLSWLENGEELNAINTTVSQDPETELYTGSSKLDFNMTTNHSFMCLIKYGHLRVNQTFSWNTPKQEHFP
SEQ:233_ctla5x1f1      (161) ICSTSGGFPEPHLFWLENGEELNAINTTVSQDPETELYTVSSKLDFNMTANHSFVCLIKYGHLRVNQTFNMNTPKQEHFP
SEQ:234_ctla5x1d7      (161) ICSTSGGFPEPHLSWLENGEELNAINTTVSQDPETELYAVSSKLDFNMTTNHSFMCLIRYGHLRVNQTFNMNTPKQEHFP
SEQ:235_ctla2x4g9      (161) ICSTSGGFPEPRLAWMEDGEELNAISTTVSQDPGTELCTVSSKLDFNMTTNHSFMCLIKYGHLRVNQTFNMNTPKQEHFP
SEQ:236_ctla2x4a6      (161) ICSTSGGFPEPHLSWLENGEELNAISTTVSQDPETELYAXSSKLDFNMTTNHSFMCLIKYGHLRVNQTFNMNTPKQEHFP
SEQ:237_ctla2x2f3      (160) ICSTSGGFPEPHLSWLENGEELNAINTTVSQDPGTELYTVSSKLDFNMTTNHSFMCLIKYGHLRVNQTFNMNTPKQEHFP
SEQ:238_ctla2x2f12     (161) ICSTSGGFPEPHLSWLENGEELNAINTTVSQDPETELYAVSSKLDFNMTTNHSFMCLIKYGHLRANQTFNMNTPKQEHFP
SEQ:239_ctla2x1g8      (161) ICSTSGGFPEPHLSWLENGEELNAINTTVSQDPGTELYTVSSKLDFNMTTNRSFVCLIKYGHLRVNQTFNMNTPKQEHFP
SEQ:240_ctla2x1f10     (161) ICSTSGGFPEPRLAWMEDGEELNAINTTVSQDPGTELYTVSSKLDFNMTTNHSFMCLIKYGHLRVNQTFNMNTPKQEHFP
SEQ:241_ctla2x1c9      (161) ICSTSGGFPEPHLSWLENGEELNAINTTVSQDPGTELYTVSSKLDFNMTTNHSFMCLIKYGHLRVNQTFNMNTPKQEHFP
SEQ:242_ctla2x1h12     (161) ICSTSGGFPEPHLSWLENGEELNAISTTASQDPETELYTVSSKLDFNMTTNHSFMCLIKYGHLRVNQTFNMNTPKQEHFP
SEQ:243_ctla2x1e2      (161) ICSTSGGFPEPHLSWLENGEELNAINTTVSQDPGTELYAVSSKLDFNMTTNHSFMCLIKYGHLRVNQTFNMNTPKQEHFP
SEQ:244_ctla2x1c4      (161) ICSTSGGFPEPHLSWLENGEELNAINTTVSQDPGTELYAVSSKLDFNMTTNHNFMCLIKYGHLRVNQTFNMNTPKQEHFP
SEQ:245_ctla2x1b12     (161) ICSTSGGFPEPHLFWLENGEELNAINTTVSQDPGTELYTVSSKLDFNMTANHSFMCLIKYGHLRVNQTFNMNTPKQEHFP
SEQ:246_ctla2x2f1      (161) ICSTSGGFPEPRLAWMEDGEELNAINTTASQDPETELYTVSSKLDFNMTTNRSFVCLIKYGHLRVNQTFNMNTPKQEHFP
SEQ:247_ctla5x4h1      (161) ICSTSGGFPEPHLSWLENGEELNAINTTVSQDPGTELYTVSSKLDFNMTTNRSFVCLIKYGHLRVNQTFNMNTPKQEHFP
SEQ:248_ctla5x4a1      (161) ICSTSGGFPEPHLSWLENGEELNAINTTASQDPETELYTVSSKLDFNMTTNRSFVCLIKYGHLRVNQTFNMNTPKQEHFP
SEQ:249_ctla5x2f3      (161) ICSTSGGFPEPHLSWLENGEELNAINTTASQDPETELYTVSSKLDFNMTTNRSFVCLIKYGHLRVNQTFNMNTPKQEHFP
SEQ:250_ctla5x2e12     (161) ICSTSGGFPEPHLSWLENGEELNAISTTVSQDPGTELYAVSSKLDFNMTTNRSFVCLIKYGHLRVNQTFNMNTPKQEHFP
SEQ:251_ctla2x4h11     (161) ICSTPGGFPEPRLAWMEDGEELNAISTTVSQDPGTELYAVSSKLDFNMTTNHSFMCLIKYGHLRVNQTFNMNTTKQEHFP
SEQ:252_ctla2x3h2      (161) ICSTSGGFPEPHLSWLENGEELNAINTTVSQDPETELYTVSSKLDFNMTTNHSFMCLIKYGHLRVNQTFNWNTTKQEHFP
SEQ:286_CTLA4BP_Con    (161) ICSTSGGFPEPHLSWLENGEELNAINTTVSQDPETELYTVSSKLDFNMTTNHSFMCLIKYGHLRVNQTFNMNTPKQEHFP
```

```
                    ECD  |      TMD      |         CD
                         241                                                              288
SEQ:278_Human_B7-1   (241) DNLLPSWAITLISVNGIFVICCLTYCFAPRCRERRRNERLRRESVRPV SEQ:069_R1_CTLA4BP-5   (241) DNLLPSWAITLISVNGIFVICCLTYCFAPRCRERRRNERLRRESVRPV
SEQ:070_R1_CTLA4BP-7   (241) DNLLPSWAITLISVNGIFVICCLTYCFAPRCRERRRNERLRRESVRPV
SEQ:071_R1_CTLA4BP-11  (241) DNLLPSWAITLISVNGIFVICCLTYCFAPRCRERRRNERLRRESVHPV
SEQ:072_R1_CTLA4BP-13  (241) DNLLPSWAITLISANGIFVICCLTYCFAPRCRERKSNERLRRESVRPV
SEQ:073_R1_CTLA4BP-27  (241) DNLLPSWAITLISVNGIFVICCLTYCFAPRCRERRNETLRRESVRPV
SEQ:074_R2_CTLA4BP-5x2-10c (241) DNPLPSWAITLISVNGIFVICCLTYCFAPRCRERR-NETLRRESVRPV
SEQ:075_R2_CTLA4BP-5x2-11d (241) DNLLPSWAITLISVNGIFVICCLTYCFAPRCRERKSNETLRRESVRPV
SEQ:076_R2_CTLA4BP-5x2-12F (241) DNPLPSWAITLISVNGIFVICCLTYRFAPRCRERRSNETLRRESVRPV
SEQ:077_R2_CTLA4BP-5x2-2g  (241) DNLLPSWAITLISVNGIFVICCLTYCFAPRCRERKSNERLRRESVRPV
SEQ:078_R2_CTLA4BP-5x2-3c  (241) DNLLPSWAITLISANGIFVICCLTYCFAPRCRERRRNERLRRESVCPV
SEQ:079_R2_CTLA4BP-5x2-4c  (241) DNLLPSWAITLISANGIFVICCLTYCFAPRCRERRRNERLRRESVHPV
SEQ:080_R2_CTLA4BP-5x2-7b  (241) DNLLPSWAITLISVNGIFVICCLTYCFAPRCRERRRNETLRRESVRPV
SEQ:081_R2_CTLA4BP-5x2-8c  (241) DNLLPSWAITLISANGIFVICCLTYCFAPRCRERRSNERLRRESVHPV
SEQ:082_R2_CTLA4BP-5x3-10e (241) DNLLPSWAITLISANGIFVICCLTYCFAPRCRERKSNERLRRESVRPV
SEQ:083_R2_CTLA4BP-5x3-11b (241) DNLLPSWAITLISVNGIFVICCLTYCFAPGCRERKSNERLRRESVRPV
SEQ:084_R2_CTLA4BP-5x3-6f  (241) DNLLPSWAITLISVNGIFVICCLAYCFAPRCRERKSNERLRRESVRPV
SEQ:085_R2_CTLA4BP-5x4-11d (241) DNLLPSWAITLISANGIFVICCLTYRFAPRCRERRRNERLRRESVRPV
SEQ:086_R2_CTLA4BP-5x4-12c (241) DNLLPSWAITLISANGIFVICCLTYCFAPRCRERRRNETLRRESVCPV
SEQ:087_R2_CTLA4BP-5x4-1f  (241) DNLLPSWAITLISVNGIFVICCLTYCFAPRCRERRRNETLRRESVRPV
SEQ:088_R2_CTLA4BP-5x5-2e  (241) DNLLPSWAITLISVNGIFVICCLTYCFAPRCRERRRNERLRRESVRPV
SEQ:089_R2_CTLA4BP-5x5-6e  (241) DNLLPSWAITLISANGIFVICCLTHCFAPRCRERKRNERLRRESVRPV
SEQ:090_R2_CTLA4BP-5x6-9d  (241) DNLLPSWAITLISVNGIFVICCLTYCFAPRCRERRRNERLRRESVRPV
SEQ:091_R2_CTLA4BP-5x8-1f  (241) DNLLPSWAITLISVNGIFVICCLTYCFAPRCRERKSNERLRRESVRPV
SEQ:092_R2_CTLA4BP-5x9-12c (241) DNLLPSWAITLISVNGIFVICCLTYCFAPRCRERKSNERLRRESVRPV
SEQ:222_ctla5x9d10     (241) DNLLPSWAITLISVNGIFVICCLTHCFAPRCRERRRNERLRRESARPV
SEQ:223_ctla5x6f6      (241) DNLLPSWAITLISVNGIFVICCLTYRFAPRCRERRRNERLRRESVCPV
SEQ:224_ctla5x5h12     (241) DNLLPSWAITLISVNGIFVICCLTYCFAPRCRERRRNGRLRRESVRPV
SEQ:225_ctla5x5c10     (241) DNLLPSWAITLISVNGIFVICCLTYCFAPRCRERRRNERLRRESVHPV
```

Fig. 3G

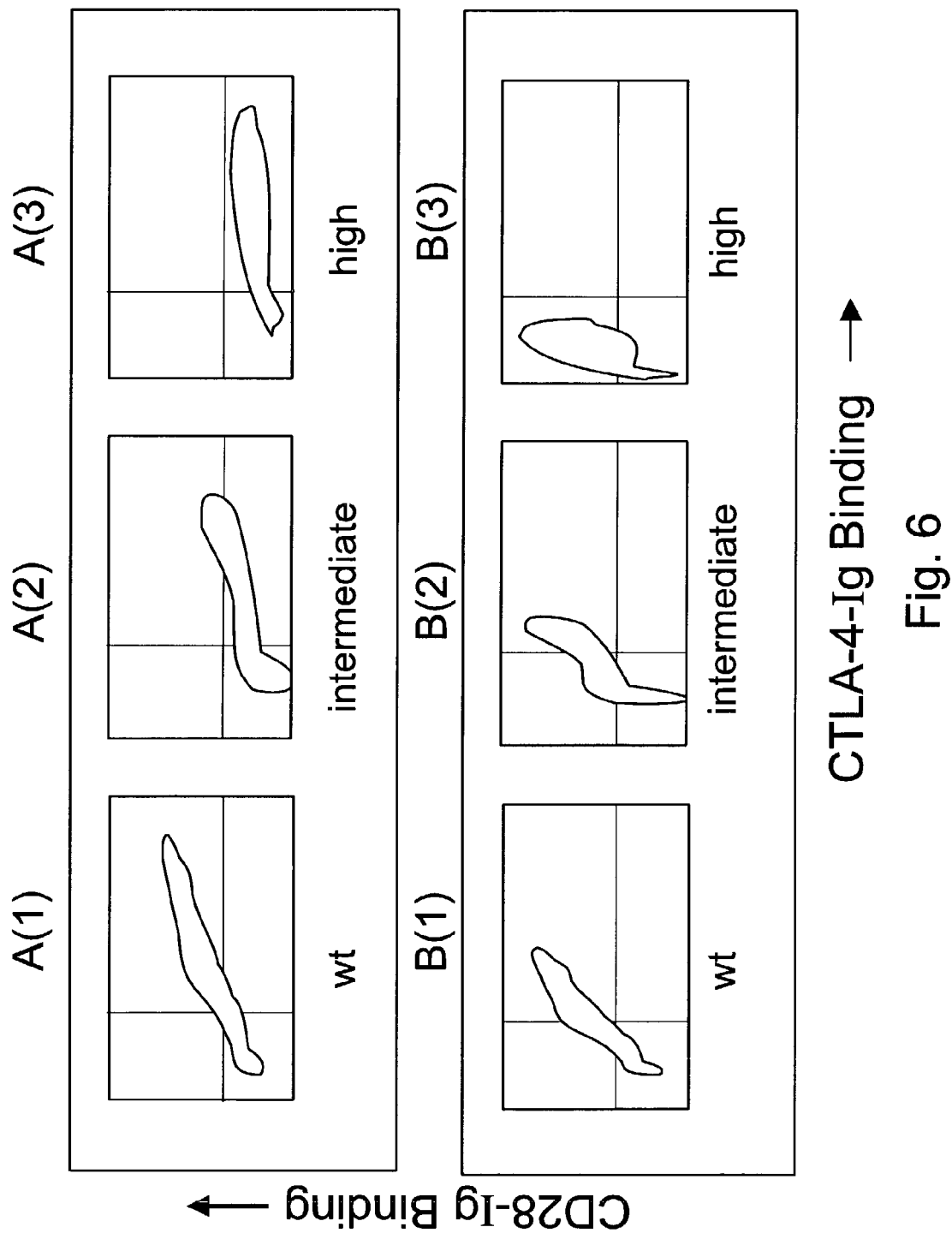

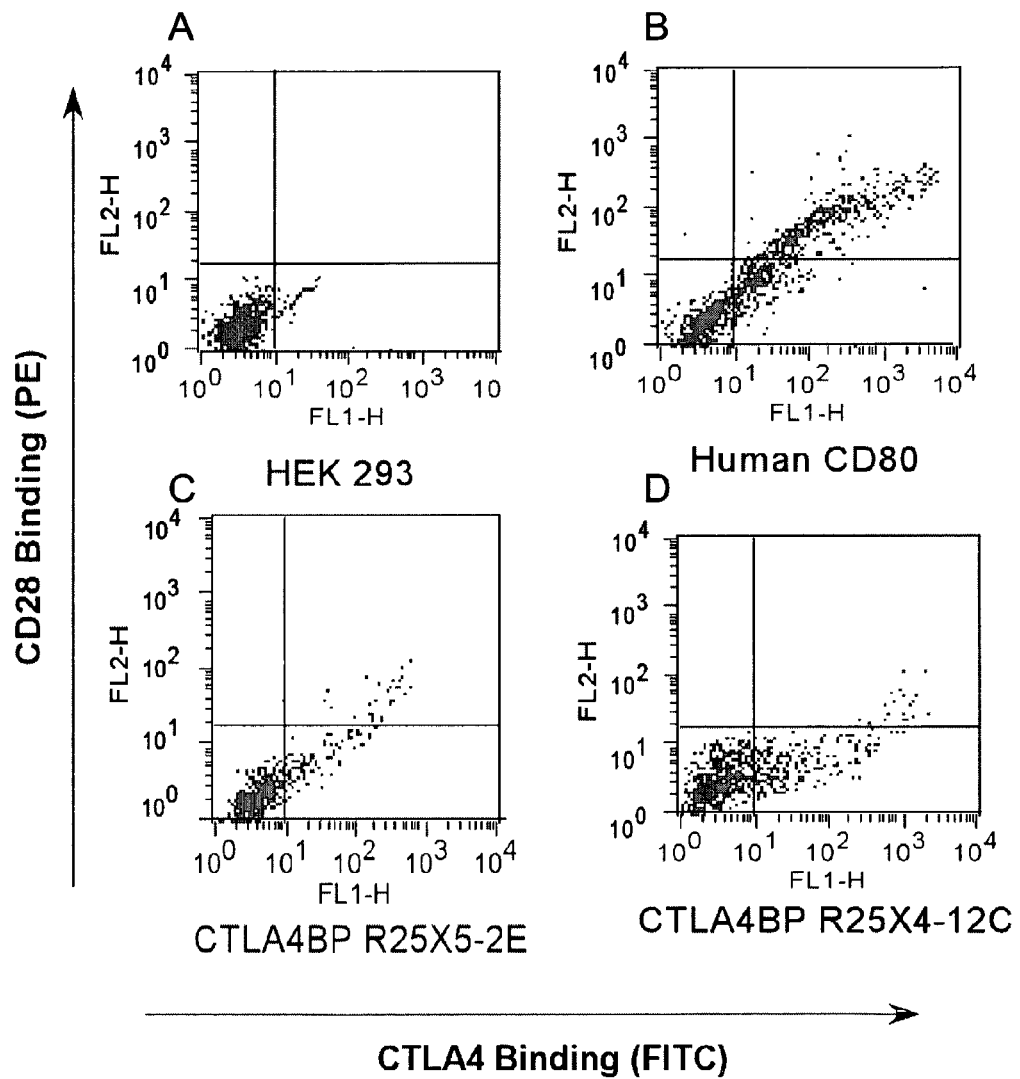
Fig. 7A-D

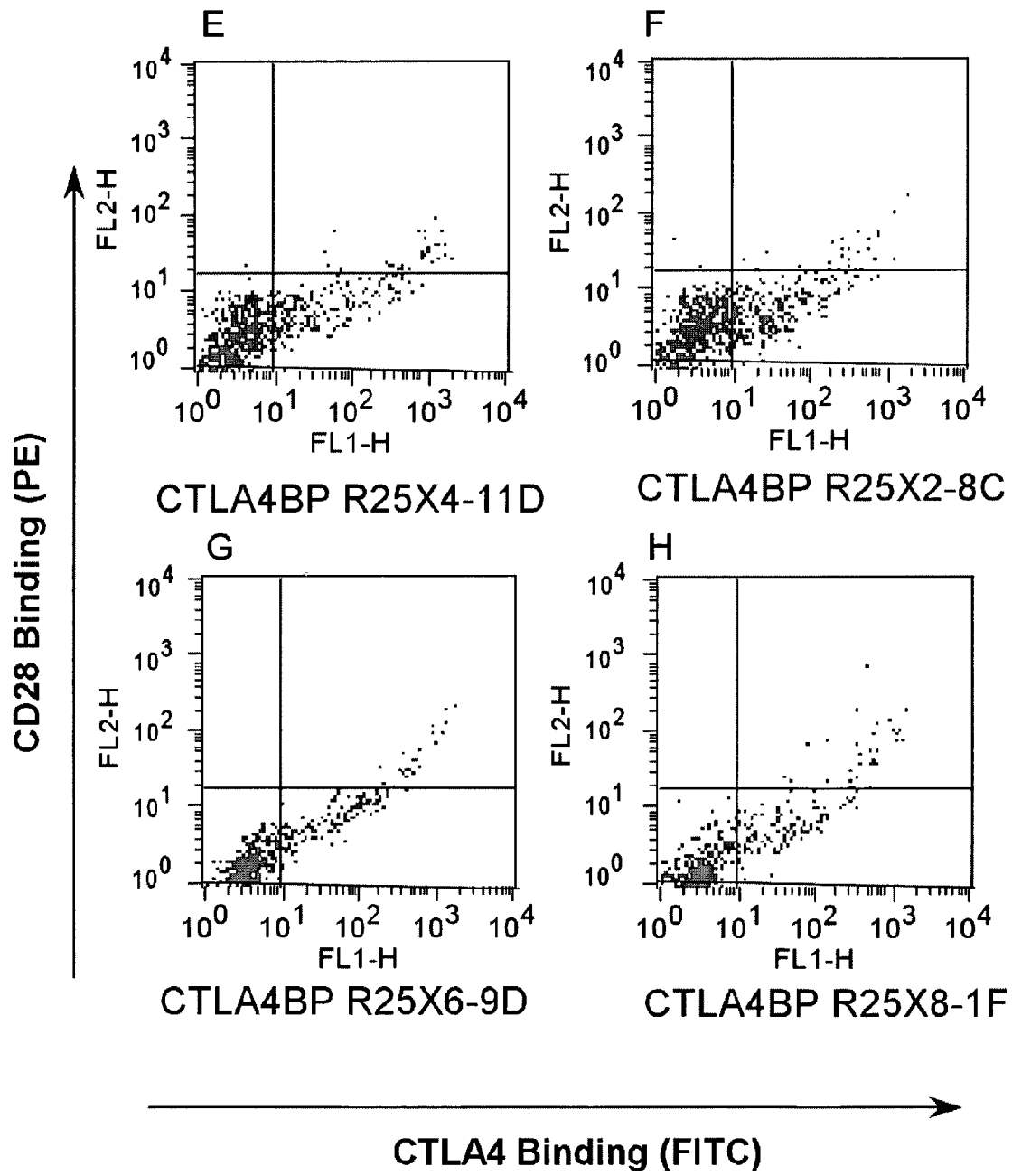
Fig. 7E-H

Fig. 8A

CTLA-4BP-5x4-12c

MGHTRRQGTSPSKCPYLKFFQLLVLAGLSHFCSGVIHVTKEVKEVATLSCGHNVSVEELAQT
RIHWQKEKKMVLTMMSGDMNIWPEYKNRTIFDITNNLSIVILALRPSDEGTYECVVLKYEKDAF
KREHLAEVMLSVKADFPTPSISDFEIPPSNIRRICSTSGGFPEPHLFWLENGEELNAINTTVSQ
DPETELYTVSSKLDFNMTTNHSFMCLIKYGHLRVNQTFNWNTPKQEHFPDNLLPSWAITLISA
NGIFVICCLTYRFAPRCRERKSNETLRRESVRPV

MGHTMKWGSLPPKRPCLWLSQLLVLTGLFYFCSGITPKSVTKRVKETVMLSCDYNTSTEELT
SLRIYWQKDSKMVLAILPGKVQVWPEYKNRTITDMNDNPRIVILALRPSDSGTYTCVIQKPVLK
GAYKLEHLASVRLMIRADFPVPTINDLGNPSPNIRRLICSTSGGFPRPHLYWLENGEELNATNT
TVSQDPGTELYMISSELDFNVTNNHSIVCLIKYGELSVSQIFPWSKPKQEPPIDQLPFWVIIPVS
GALVLTAVVLYCLACRHVARWKRTRRNEETVGTERLSPIYLGSAQSSG human / orangutan / rhesus / baboon / rhesus/baboon / cow / rabbit Expression of CTLA-4BP-Ig and CD28BP-Ig Proteins

CO-STIMULATORY POLYPEPTIDES

CROSS-REFERENCES TO RELATED APPLICATIONS

This application claims priority to and benefit of U.S. Provisional Patent Application Ser. Nos. 60/213,946, filed on Jun. 23, 2000, and 60/241,245, filed on Oct. 17, 2000, the disclosure of each of which is incorporated herein by reference in its entirety for all purposes.

STATEMENT REGARDING FEDERALLY SPONSORED RESEARCH AND DEVELOPMENT

This work was supported in part by a grant from the Defense Advanced Research Projects Agency (DARPA) (Grant No. N65236-98-1-5401). The Government may have certain rights in this invention.

COPYRIGHT NOTIFICATION

Pursuant to 37 C.F.R. 1.71(e), Applicants note that a portion of this disclosure contains material which is subject to copyright protection. The copyright owner has no objection to the facsimile reproduction by anyone of the patent document or patent disclosure, as it appears in the Patent and Trademark Office patent file or records, but otherwise reserves all copyright rights whatsoever.

FIELD OF THE INVENTION

The present invention relates generally to polynucleotides and polypeptides encoded therefrom, as wells as vectors, cells, antibodies, and methods for using and producing the polynucleotides and polypeptides.

BACKGROUND OF THE INVENTION

T cells are a crucial component of the immune system. Not only is T cell activation required for all specific immune responses against infectious agents, but T cells also play an important role in tumor immunity and in autoimmune and allergic diseases. T cell activation is initiated when T cells recognize their specific antigen (Ag) in the context of major histocompatibility complex (MHC) molecules. T cell activation is well known by those of ordinary skill in the art and is characterized by such things as, e.g., cytokine synthesis, induction of various activation markers such as CD25 (interleukin-2 (IL-2) receptor), etc. CD4+T cells recognize their immunogenic peptides in the context of MHC class II molecules, whereas CD8+T cells recognize their immunogenic peptides in the context of MHC class I molecules. For induction of T cell activation, cytokine synthesis or effector function, a second signal, mediated through CD28, is required. Two ligands for CD28 are B7-1 (CD80) and B7-2 (CD86). B7-1 and B7-2 are termed co-stimulatory molecules and are typically expressed on professional antigen-presenting cells (APCs). In addition to binding the CD28 receptor, B7-1 and B7-2 also bind the CTLA-4 (CD152) receptor on T cells.

B7 molecules mediate both positive and negative signals to T cells by binding to CD28 and CTLA-4 (CD152) molecules on T cells. CTLA-4 is a negative regulator of the immune system. In general, wild-type (WT) B7-1, e.g., human B7-1, preferentially binds CTLA-4 more strongly than it binds CD28. Typically, wild-type B7-1, e.g., human B7-1, binds CTLA-4 with about 100 times greater affinity than it binds CD28. Binding of B7-1 or B7-2 to CTLA-4 suppresses activation of T cells, resulting in reduced T cell proliferation and cytokine production (see, e.g., Walunas, T. L. et al. (1994) *Immunity* 1(5):405–413; Alegre, M. L. et al. (1998) *J Immunol* 161(7):3347–3356). Interaction between B7-1 or B7-2 and CTLA-4 expressed on T cells down-regulates T cell responses and raises thresholds required for activation by CD28. Blockade of CTLA-4/ligand interactions can also augment in vivo tumor immunity (Leach, D. et al. (1996) *Science* 271:1734–1736). Consequently, CD28 and CTLA-4 play a pivotal role in the regulation of T cell activation and both are essential for proper functioning of the immune system. For example, CD28 deficient mice are severely immunodeficient and show poor antigen specific T cell responses, while CTLA-4 deficient mice die of lymphoproliferative disease, show T cell expansion mediated by CD28 signaling and have a lack of down-regulation of T cell receptor signaling. Upon ligation by the co-stimulatory molecules B7-1 or B7-2, CD28 mediates a co-stimulatory signal that synergizes with T cell receptor signaling to induce, e.g., proliferation, cytokine production and effector functions by both CD4+ and CD8+T cells (proliferation/activation). Ligation of CTLA-4 with B7-1 (CD80) or B7-2 (CD86), however, dampens the CD80 or CD86 activating signal through CD28, resulting in down-regulation of T cell activation. CD28 ligation reduces the inhibition mediated through the CTLA-4 signaling. CTLA-4 ligation mediates tolerance and anergy.

CD28 and CTLA-4 are both involved in the generation of an immune response to genetic vaccinations (e.g., nucleic acid vaccinations (NAV), DNA vaccinations, and viral vectors). CD28 deficient mice are unable to mount T cell or antibody responses against Beta-galactosidase (Beta-gal) when immunized with a plasmid encoding the Beta-gal gene, and CTLA-4 ligation suppresses the antibody response to Beta-gal in immunized wild-type mice (Horspool, J. et al. (1998), *J Immunol* 160:2706–2714). Expression of B7-1 on human myeloma cells (Wendtner, C. et al. (1997) *Gene Therapy* 4(7):726–735), murine mammary tumors (Martin-Fontecha, A. et al.(2000) *J Immunol* 164(2):698–704) or murine sarcoma (Indrova et al. (1998) *Intl J Onc* 12(2): 387–390) enhances anti-tumor immunity. Furthermore, transfection of human APCs with retroviral vectors encoding B7-1 and tumor antigens induces a stronger cytotoxic T-lymphocyte (CTL) response than transfection with similar vectors encoding the tumor antigens alone (Zajac, P. et al. (1998) *Cancer Res* 58(20):4567–4571). Anti-viral responses are also modulated by co-stimulatory molecules. For example, DNA vaccination of chimpanzees and mice with HIV antigens in conjunction with B7-2 augmented anti-viral responses (Kim, J. et al. (1998) *Vaccine* 16(19):1828–1835; Tsuji et al. (1997) *Eur J Immunol* 27(3):782–787).

The binding properties of B7-1 and B7-2 have limited their usefulness in clinical applications. The present invention addresses needs for molecules having varied abilities to preferentially bind to and/or signal through either CD28 or CTLA-4 receptor and methods of using such molecules for selected and differential manipulation of T cell responses in vitro, ex vivo, and in vivo methods. Such molecules would be of beneficial use in a variety of applications, including, e.g., therapeutic and prophylactic treatments and vaccinations. The present invention fulfills these and other needs.

SUMMARY OF THE INVENTION

In one aspect, the present invention provides novel co-stimulatory molecules (abbreviated as "NCSM") molecules, including polypeptides and proteins, related fusion polypeptide or fusion protein molecules, or functional equivalents thereof, homologues, and fragments of said polypeptide and protein molecules or equivalents, analogs, or derivatives thereof. The invention also provides nucleic acids encoding any of these polypeptides, proteins, fragments or variants thereof. In addition, the invention provides vectors comprising such nucleic acids, and uses of such NCSM polypeptides and NCSM nucleic acids; and other features are apparent upon further review.

Generally speaking, a "co-stimulatory molecule" refers to a molecule that acts in association or conjunction with, or is involved with, a second molecule or with respect to an immune response in a co-stimulatory pathway. In one aspect, a co-stimulatory molecule may be an immunomodulatory molecule that acts in association or conjunction with, or is involved with, another molecule to stimulate or enhance an immune response. In another aspect, a co-stimulatory molecule is immunomodulatory molecule that acts in association or conjunction with, or is involved with, another molecule to inhibit or suppress an immune response. A "co-stimulatory molecule" need not act simultaneously with or by the same mechanism as the second molecule.

The term "NCSM" in reference to a molecule is not intended to limit the molecule to only those molecules that have positive co-stimulatory properties (e.g., that stimulate or augment T cell proliferation). In the initial recombination procedures described below, libraries of recombinant molecules were generated by recombining nucleotide sequences of parental co-stimulatory molecules (CSM) as discussed herein. As shown by the data and analyses presented herein, novel recombinant molecules having a variety of properties were identified and selected. For example, molecules that enhance an immune response, such as by inducing T cell activation or proliferation (e.g., agonists), and molecules that down-regulate or inhibit an immune response, such as by inhibiting T cell activation or proliferation (e.g., antagonists) were identified and selected. Further, molecules that preferentially bind and/or signal through either or both the CD28 and CTLA-4 receptor were identified and selected. Thus, the term "NCSM" is not limited to molecules having the co-stimulatory properties of the parent sequences, but is intended to refer collectively to all polypeptides of the invention, and nucleic acids encoding them, and other embodiments as described herein, unless specifically noted otherwise.

In one aspect, the invention includes isolated or recombinant NCSM polypeptides, variants, homologues, derivatives, analogs, and fragments thereof. The invention includes recombinant NCSM polypeptides having varied abilities to preferentially bind to and/or signal through CD28 and/or CTLA-4 receptor and provide for selected and differential manipulation of T cell responses in vitro, ex vivo, and in vivo. The invention also includes isolated or recombinant NCSM nucleic acids, variants, homologues, derivatives, analogs, and fragments thereof that encode polypeptides having varied abilities and uses described above. Such NCSM polypeptide and polynucleotides are useful in a variety of applications, including e.g., therapeutic and prophylactic treatment methods, vaccinations, and diagnostic assays described below. The invention also provides NCSM polypeptides, and polynucleotide encoding such polypeptides, that strongly or preferentially bind at least one of CD28 or CTLA-4, but do not effectuate signaling; such molecules are useful in methods as potential antagonists of endogenous molecules, such as e.g., endogenous co-stimulatory molecules. Further, the invention provides NCSM polypeptides, and polynucleotides encoding them, having improved or altered receptor/ligand binding affinities and methods of using such molecules, including in pharmaceutical, prophylactic, therapeutic, vaccine, and diagnostic applications.

In one aspect, the invention provides an isolated or recombinant polypeptide comprising an extracellular domain sequence, said extracellular domain sequence having at least about 75% amino acid sequence identity to an extracellular domain sequence of, or the full-length sequence of, at least one of SEQ ID NOS:48–68, 174–221, 283–285, and 290–293, and is not a naturally-occurring extracellular domain sequence, and wherein said polypeptide has a CD28/CTLA-4 binding affinity ratio equal to or greater than the CD28/CTLA-4 binding affinity ratio of human B7-1. Some such polypeptides induce T-cell proliferation or T-cell activation or both T-cell proliferation and T-cell activation. In some embodiments, the T cell activation or proliferation response is at least equal to or greater than that caused by WT hB7-1. Other such polypeptides modulate T-cell activation, but do not induce proliferation of purified T-cells activated by soluble anti-CD3 mAbs.

In another aspect, the invention provides an isolated or recombinant polypeptide, which polypeptide comprises a non-naturally-occurring amino acid sequence encoded by a nucleic acid comprising a polynucleotide sequence selected from the group of: (a) a polynucleotide sequence selected from SEQ ID NOS:1–21 and 95–142, or a complementary polynucleotide sequence thereof; (b) a polynucleotide sequence encoding a polypeptide selected from SEQ ID NOS:48–68, 174–221, 283–285, and 290–293, or a complementary polynucleotide sequence thereof; (c) a polynucleotide sequence which hybridizes under highly stringent conditions over substantially the entire length of polynucleotide sequence (a) or (b); (d) a polynucleotide sequence comprising all or a fragment of (a), (b), or (c), wherein the fragment encodes a polypeptide having a CD28/CTLA-4 binding affinity ratio equal to or greater than the CD28/CTLA-4 binding affinity ratio of human B7-1; (e) a polynucleotide sequence encoding a polypeptide, the polypeptide comprising an amino acid sequence which is substantially identical over at least about 150 contiguous amino acid residues of any one of SEQ ID NOS:48–68, 174–221, 283–285, and 290–293; and (f) a polynucleotide sequence encoding a polypeptide that has a CD28/CTLA-4 binding affinity ratio equal to or greater than the CD28/CTLA-4 binding affinity ratio of human B7-1, which polynucleotide sequence has at least about 70% identity to at least one polynucleotide sequence of (a), (b), (c), or (d).

Also provided is an isolated or recombinant polypeptide comprising a sequence according to the formula: MGHTM-X6-W-X8-SLPPK-X14-PCL-X18-X19-X20-QLLVLT-X27-LFYFCSGITPKSVTKRVKETVMLSCDY-X55-TSTE-X60-LTSLRIYW-X69-KDSKMVLAILPGKVQVWPEYKNRTITDMNDN-X101-RIVI-X106-ALR-X110-SD-X113-GTYTCV-X120-QKP-X124-LKGAYKLEHL-X135-SVRLMIRADFPVP-X149-X150-X151-DLGNPSPNIRRLICS-X167-X168-X169-GFPRPHL-X177-WLENGEELNATNTT-X192-SQDP-X197-T-X199-LYMISSEL-X208-FNVTNN-X215-SI-X218-CLIKYGEL-X227-VSQIFPWSKPKQEPPIDQLPF-X249-VIIPVSGALVL-X261-A-X263-VLY-X267-X268-ACRH-X273-ARWKRTRRNEETVGTE RLSPIYLGSAQSSG (SEQ ID NO:284), or a subsequence thereof comprising the extracellular domain, wherein position X6 is Lys or Glu; position X8 is Arg or Gly; position X14 is Arg or Cys; position X18 is Trp or Arg; position X19 is Pro or Leu; position X20 is Ser or Pro; position X27 is Asp or Gly; position X55 is Asn or Ser; position X60 is Glu or Lys; position X69 is Gln or Arg; position X101 is Pro or Leu; position X106 is Leu or Gln; position X110 is Pro or Leu; position X113 is Lys or Ser; position X120 is Val or Ile; position X124 is Val or Asp; position X135 is Thr or Ala; position X149 is Thr, Ser, or del; position X150 is Ile or del; position X151 is Asn or Thr; position X167 is Thr or del; position X169 is Ser or del; position X169 is Gly or del; position X177 is Cys or Tyr; position X192 is Val or Leu; position X197 is Gly or Glu; position X199 is Glu or Lys; position X208 is Gly or Asp; position X215 is His or Arg; position X218 is Ala or Val; position X227 is Ser or Leu; position X249 is Trp, Leu, or Arg; position X261 is Ala or Thr; position X263 is Val, Ala, or Ile; position X267 is Arg or Cys; position X268 is Pro or Leu; and position X273 is Gly or Val.

In yet another aspect, the invention provides an isolated or recombinant polypeptide comprising a subsequence of an amino acid sequence set forth in any of SEQ ID NOS:48–68, 174–182, 184–221, 283–285, and 290–293, wherein the subsequence is the extracellular domain of said amino acid sequence.

The invention further provides isolated or recombinant polypeptides comprising a sequence having at least about 95% identity to at least one of SEQ ID NOS:69–92, 222–252, 286–289, or a subsequence thereof comprising the extracellular domain, wherein said sequence (a) is a non naturally-occurring sequence, and (b) comprises at least one of: Gly at position 2; Thr at position 4; Arg at position 5; Gly at position 8; Pro at position 12; Met at position 25; Cys at position 27; Pro at position 29; Leu at position 31; Arg at position 40; Leu at position 52; His at position 65; Ser at position 78; Asp at position 80; Tyr at position 87; Lys at position 120; Asp at position 122; Lys at position 129; Met at position 135; Phe at position 150; Ile at position 160; Ala at position 164; His at position 172; Phe at position 174; Leu at position 176; Asn at position 178; Asn at position 186; Glu at position 194; Gly at position 196; Thr at position 199; Ala at position 210; His at position 212; Arg at position 219; Pro at position 234; Asn at position 241; Leu at position 244; Thr at position 250; Ala at position 254; Tyr at position 265; Arg at position 266; Glu at position 273; Lys at position 275; Ser at position 276; an amino acid deletion at position 276; or Thr at position 279, wherein the position number corresponds to that of the human B7-1 amino acid sequence (SEQ ID NO:278), wherein said polypeptide has a CTLA-4/CD28 binding affinity ratio equal to or greater than the CTLA-4/CD28 binding affinity ratio of human B7-1.

In another aspect, the invention provides isolated or recombinant polypeptides comprising a sequence that differs from a primate B7-1 sequence in at least one mutation selected from: Ser 12 Pro; Leu 25 Met; Gly 27 Cys; Ser 29 Pro; Lys 40 Arg; His 52 Leu; Tyr 65 His; Glu 122 Asp; Glu 129 Lys; Thr 135 Met; Thr 164 Ala; Ser 174 Phe; Glu 196 Gly; Ala 199 Thr; Thr 210 Ala; Lys 219 Arg; Thr 234 Pro; Asp 241 Asn; Val 254 Ala; Arg 275 Lys; Arg 276 Ser; or Arg 279 Thr; the mutation being indicated relative to human B7-1 with the amino acid sequence shown in SEQ ID NO:278, wherein said sequence does not occur in nature, and wherein said polypeptide has a CTLA-4/CD28 binding affinity ratio equal to or greater than the CTLA-4/CD28 binding affinity ratio of human B7-1.

Also included are isolated or recombinant polypeptides comprising a sequence having at least about 75% identity to at least one of SEQ ID NOS:263–272, or a subsequence thereof comprising the extracellular domain, where the sequence is not naturally-occurring, and the polypeptide has a CTLA-4/CD28 binding affinity ratio equal to or greater than the CTLA-4/CD28 binding affinity ratio of human B7-1.

In yet another aspect, the invention includes an isolated or recombinant polypeptides which comprises a non naturally-occurring amino acid sequence encoded by a nucleic acid comprising a polynucleotide sequence selected from: (a) a polynucleotide sequence selected from SEQ ID NOS:22–45, 143–173, 253–262, or a complementary polynucleotide sequence thereof; (b) a polynucleotide sequence encoding a polypeptide selected from SEQ ID NOS:69–92, 222–247, 263–272, 286–289, or a complementary polynucleotide sequence thereof; (c) a polynucleotide sequence which hybridizes under highly stringent conditions over substantially the entire length of polynucleotide sequence (a) or (b); (d) a polynucleotide sequence comprising all or a fragment of (a), (b), or (c), wherein the fragment encodes a polypeptide having a CTLA-4/CD28 binding affinity ratio equal to or greater than the CTLA-4/CD28 binding affinity ratio of human B7-1; (e) a polynucleotide sequence encoding a polypeptide, the polypeptide comprising an amino acid sequence which is substantially identical over at least about 150 contiguous amino acid residues of any one of SEQ ID NOS:69–92, 222–247, 263–272, 286–289, and (f) a polynucleotide sequence encoding a polypeptide that has a CTLA-4/CD28 binding affinity ratio equal to or greater than the CTLA-4/CD28 binding affinity ratio of human B7-1, which polynucleotide sequence has at least about 70% identity to at least one polynucleotide sequence of (a), (b), (c), or (d).

The invention also includes an isolated or recombinant polypeptide comprising a sequence according to the formula:

MGHTRRQGTSP-X12-KCPYLKFFQLLV-X25-ACL-X29-HLCSGVIHVT-X40-EVKEVATLSCGLNVS-VEELAQTRIHWQKEKKMVLTM MSGDMNIW-PEYKNRTIFDITNNLSIVILALRPSDEGTYECVVLKY-X122-KDAFKR-X129-HLAEVMLSVKAD FPTPSITDFEIPPSNIRRIICS-X164-SGGFPEPHLF-WLENGEELNAINTTVSQDPET-X196-LYTVSSKLD-FNM TANHSFMCLI-X219-YGHLRVNQTFNWNTP-KQEHFP-X241-NLLPSWA ITLISANGIFVICCLTYRFAPRCRERKS-NETLRRESVCPV (SEQ ID NO:287), or a subsequence thereof comprising the extracellular domain, wherein position X12 is Ser or Pro; position X25 is Leu or Met; position X29 is Ser or Pro; position X40 is Lys or Arg; position X122 is Glu or Asp; position X129 is Glu or Lys; position X164 is Thr or Ala; position X196 is Glu or Gly; position X219 is Lys or Arg; position X241 is Asp or Asn.

The invention also provides an isolated or recombinant polypeptide comprising a subsequence of an amino acid sequence set forth in any of SEQ ID NOS:69–92, 222–247, 263–272, and 286–289, wherein the subsequence is the extracellular domain or full-length sequence of such amino acid sequence. Furthermore, the invention includes the full-length polypeptide sequence and any subsequence thereof, e.g., signal peptide, ECD, transmembrane domain, and/or cytoplasmic domain of any of SEQ ID NOS:66, 81, 85, 86, 88, 90, 91, 285, 288, 289, 291, and 294, and nucleic acid sequences encoding any of these amino acid sequences.

The invention provides isolated or recombinant nucleic acids comprising a polynucleotide sequence selected from: (a) a polynucleotide sequence selected from SEQ ID NOS: 1–21 and 95–142, or a complementary polynucleotide sequence thereof; (b) a polynucleotide sequence encoding a polypeptide selected from SEQ ID NOS:48–68, 174–221, 283–285, and 290–293, or a complementary polynucleotide sequence thereof; (c) a polynucleotide sequence which hybridizes under highly stringent conditions over substantially the entire length of polynucleotide sequence (a) or (b); and (d) a polynucleotide sequence comprising all or a fragment of (a), (b), or (c), wherein the fragment encodes a polypeptide having a CD28/CTLA-4 binding affinity ratio equal to or greater than the CD28/CTLA-4 binding affinity ratio of human B7-1.

The invention also includes isolated or recombinant nucleic acids comprising a polynucleotide sequence encoding a polypeptide, wherein the encoded polypeptide comprises an amino acid sequence which is (a) substantially identical over at least about 150 or 200 contiguous amino acid residues of any one of SEQ ID NOS:48–68, 174–221, 283–285, and 290–293 and (b) is a non naturally-occurring sequence.

In addition, the invention includes isolated or recombinant nucleic acids comprising a nucleotide sequence coding for a polypeptide comprising the amino acid sequence set forth in any of SEQ ID NOS:48–68, 174–221, 283–285, and 290–293, or a subsequence thereof, wherein the subsequence comprises at least one of: the signal sequence, extracellular domain, or transmembrane domain of said polypeptide, and the cytoplasmic domain of said polypeptide, and wherein the amino acid sequence or subsequence is a non naturally-occurring sequence. Similarly, fragments of the above nucleotides that encode a polypeptide that has a substantially equivalent or equivalent binding activity of a NCSM polypeptide molecule, produces a substantially equivalent or equivalent NCSM-polypeptide-mediated immune response, e.g., induction or inhibition of T cell activation or proliferation, or cytokine production are a feature.

Also provided is an isolated or recombinant nucleic acid comprising a polynucleotide sequence selected from: (a) a polynucleotide sequence selected from SEQ ID NOS:22–45, 143–173, or a complementary polynucleotide sequence thereof; (b) a polynucleotide sequence encoding a polypeptide selected from SEQ If) NOS:69–92, 222–247, 286–289, or a complementary polynucleotide sequence thereof; (c) a polynucleotide sequence which hybridizes under highly stringent conditions over substantially the entire length of polynucleotide sequence (a) or (b); and (d) a polynucleotide sequence comprising all or a fragment of (a), (b), or (c); wherein (c) or (d) encodes a polypeptide having a non naturally-occurring sequence comprising at least one of:

Gly at position 2; Thr at position 4; Arg at position 5; Gly at position 8; Pro at position 12; Met at position 25; Cys at position 27; Pro at position 29; Leu at position 31; Arg at position 40; Leu at position 52; His at position 65; Ser at position 78; Asp at position 80; Tyr at position 87; Lys at position 120; Asp at position 122; Lys at position 129; Met at position 135; Phe at position 150; Ile at position 160; Ala at position 164; His at position 172; Phe at position 174; Leu at position 176; Asn at position 178; Asn at position 186; Glu at position 194; Gly at position 196; Thr at position 199; Ala at position 210; His at position 212; Arg at position 219; Pro at position 234; Asn at position 241; Leu at position 244; Thr at position 250; Ala at position 254; Tyr at position 265; Arg at position 266; Glu at position 273; Lys at position 275; Ser at position 276; an amino acid deletion at position 276; and Thr at position 279, wherein the position number corresponds to that of the human B7-1 amino acid sequence (SEQ ID NO:278), and wherein said polypeptide has a CTLA-4/CD28 binding affinity ratio equal to or greater than the CTLA-4/CD28 binding affinity ratio of human B7-1.

The invention further provides an isolated or recombinant nucleic acid comprising a polynucleotide sequence selected from: (a) a polynucleotide sequence selected from SEQ ID NOS:253–262, or a complementary polynucleotide sequence thereof; (b) a polynucleotide sequence encoding a polypeptide selected from SEQ ID NOS:263–272, or a complementary polynucleotide sequence thereof; (c) a polynucleotide sequence which hybridizes under highly stringent conditions over substantially the entire length of polynucleotide sequence (a) or (b) and encodes a polypeptide having a non naturally-occurring sequence; and (d) a polynucleotide sequence comprising all or a fragment of (a), (b), or (c), wherein the fragment encodes a polypeptide having (i) a non naturally-occurring sequence and (ii) a CTLA-4/CD28 binding affinity ratio equal to or greater than the CTLA-4/CD28 binding affinity ratio of human B7-1.

The invention also includes an isolated or recombinant nucleic acid comprising a polynucleotide sequence encoding a polypeptide that comprises an amino acid sequence which is substantially identical over at least about 150 contiguous amino acid residues of any one of SEQ ID NOS:69–92, 222–247, 263–272, and 286–289.

The invention also provides an isolated or recombinant nucleic acid comprising a nucleotide sequence coding for a polypeptide comprising the amino acid sequence set forth in any of SEQ ID NOS:69–92, 222–247, 263–272, and 286–289, or a subsequence thereof, wherein the subsequence comprises at least one of the signal sequence, ECD, transmembrane domain, and cytoplasmic domain of said polypeptide, and the amino acid sequence or subsequence is a non naturally-occurring sequence.

In another aspect, the invention provides an isolated or recombinant nucleic acid encoding a polypeptide that has a CTLA-4/CD28 binding affinity ratio equal to or greater than the CTLA-4/CD28 binding affinity ratio of human B7-1, produced by mutating or recombining at least one nucleic acids described above. Also included is an isolated or recombinant polypeptide comprising a sequence having the formula:

MGHTMKWGSLPPKRPCLWLSQLLVLT-GLFYFCSGITPK SVTKRVKETVM-X50-SCDY-X55-X56-STEELTSLRIYWQKDSKMVL AILPGKVQVW-PEYKNRTITD MNDNPRIVILALRLSD-X113-GTYTCV-X120-QK-X123-X124-X125-X126-G-X128-X129-X130-X131-EHL-X135-SV-X138-L-X140-IRADFPVPSITDIGHPAPNVK RIRCSASG-X170-FPEPRLAWMEDGEEL NAVNTTV-X193-X194-X195-LDTELYSVSSELD-X209-N-X211-TNNHSIVCLIKYGELSVSQIFPWSKPK QEPPIDQLPFWVI-X252-X253-VSGALVLTAVVLYCLA-CRHVAR (SEQ ID NO:290), or a subsequence thereof comprising the extracellular domain, wherein position X50 is Leu or Pro; position X55 is Asn or Ser; position X56 is Ala or Thr; position X113 is Ser or Lys; position X120 is Ile or Val; position X123 is Pro or deleted; position X124 is Val, Asn, or Asp; position X125 is Leu or Glu; position X126 is Lys or Asn; position X128 is Ala or Ser; position X129 is Tyr or Phe; position X130 is Lys or Arg; position X131 is Leu or Arg; position X135 is Ala or Thr; position X138 is Arg or Thr; position X140 is Met or Ser; position X170 is Asp or Gly; position X193 is Asp or is deleted; position X194 is Gln or is deleted; position X195 is Asp or is deleted; position X211 is Val or Ala; position X252 is Ile or Val; and position X253 is Leu or Pro. The polypeptide may comprise a sequence of any of SEQ ID NOS:59, 62, 180, 184, 188, 195, 196, 200, 201, 204, 211, 213, 219, and 291.

Another feature of the invention is an isolated or recombinant polypeptide comprising a sequence according to the formula:

MGHTMKWG-X9-LPPKRPCLWLSQLLVLTGLFY-FCSG-X35-TPKSVTKRV KETVMLSCDY-X55-TSTEELTSLRIYWQKDSKMVLAILPGKVQVW PEYKNRTITDMNDNPRIVILALR-X110-SDSG-TYTCVIQKP-X124-LKGAYKLEHL-X135-SVR-LMIRADFPVPTINDLGNPSPNIR-RLICSTSGGFPRPHLYWLENG-X183-ELNATNTT-X192-SQDPETKLYMISSELDFN-X211-TSN-X215-X216-X217-LCLVKYGDLTVSQ-X231-FYWQESKPTPSANQHLTWTIIIPVSAFGISVIIAVI LTCLTCRNAAIRRQRRENEV-X288-M-X290-SCSQSP (SEQ ID NO:292), or a subsequence thereof comprising the extracellular domain, wherein position X9 is Thr or Ser; position X35 is Ile or Thr; position X55 is Asn or Ser; position X110 is Leu or Pro; position X124 is Asp or Val; position X135 is Thr or Ala; position X183 is Lys or Glu; position X192 is Leu or Val; position X211 is Met or Thr; position X215 is His or is deleted; position X216 is Ser or is deleted; position X217 is Phe or is deleted; position X231 is Thr or Ser; position X288 is Lys or Glu; position X290 is Glu or Gln, and wherein said sequence is a non naturally-occurring sequence.

The invention includes an isolated or recombinant polypeptide comprising the sequence SEQ ID NO:93 or SEQ ID NO:94, or a subsequence thereof, wherein the subsequence comprises at least one of the signal sequence, ECD, transmembrane domain, and cytoplasmic domain of said polypeptide. Also provided is an isolated or recombinant nucleic acid comprising a polynucleotide sequence selected from: (a) a polynucleotide sequence selected from SEQ ID NO:46 or SEQ ID NO:47, or a complementary polynucleotide sequence thereof; (b) a polynucleotide sequence encoding a polypeptide selected from SEQ ID NO:93, SEQ ID NO:94, or a complementary polynucleotide sequence thereof; (c) a polynucleotide sequence encoding a subsequence of a polypeptide selected from SEQ ID NO:93, SEQ ID NO:94, or a complementary polynucleotide sequence thereof, wherein the subsequence comprises at least one of: the signal sequence, extracellular domain, transmembrane domain, and cytoplasmic domain of the polypeptide.

In another aspect, the invention provides a polypeptide which is specifically bound by a polyclonal antisera raised against at least one antigen, the antigen comprising the polypeptide sequence selected from any of SEQ ID NOS: 48–94, 174–252, 263–272, 283–293, or a fragment thereof, wherein the antisera is subtracted with one or more (and optionally all) polypeptides encoded by one or more of the sequences set forth at GenBank Nucleotide Accession Nos: A92749, A92750, AA983817, AB026121, AB030650, AB030651, AB038153, AF010465, AF065893, AF065894, AF065895, AF065896, AF079519, AF106824, AF106825, AF106828, AF106829, AF106830, AF106831, AF106832, AF106833, AF106834, AF203442, AF203443, AF216747, AF257653, AH004645, AH008762, AX000904, AX000905, D49843, L12586, L12587, M27533, M83073, M83074, M83075, M83077, NM005191, S74541, S74540, S74695, S74696, U05593, U10925, U19833, U19840, U26832, U33063, U33208, U57755, U88622, X60958, Y08823, and Y09950.

The invention further includes an antibody or antisera produced by administering any NCSM polypeptide described above to a mammal, which antibody specifically binds at least one antigen, the antigen comprising a polypeptide comprising at least one amino acid sequence of any of SEQ ID NOS:48–94, 174–252, 263–272, and 283–293, which antibody does not specifically bind to a polypeptide encoded by at least one (optionally all) of the sequences at GenBank Nucleotide Accession Nos: A92749, A92750, AA983817, AB026121, AB030650, AB030651, AB038153, AF010465, AF065893, AF065894, AF065895, AF065896, AF079519, AF106824, AF106825, AF106828, AF106829, AF106830, AF106831, AF106832, AF106833, AF106834, AF203442, AF203443, AF216747, AF257653, AH004645, AH008762, AX000904, AX000905, D49843, L12586, L12587, M27533, M83073, M83074, M83075, M83077, NM005191, S74541, S74540, S74695, S74696, U05593, U10925, U19833, U19840, U26832, U33063, U33208, U57755, U88622, X60958, Y08823, and Y09950.

The invention provides an antibody or antisera which specifically binds a polypeptide which comprises any sequence selected from any of SEQ ID NOS:48–94, 174–252, 263–272, and 283–293, wherein the antibody or antisera does not specifically bind to at least one (optionally all) polypeptide encoded by at least one of GenBank Nucleotide Accession Nos: A92749, A92750, AA983817, AB026121, AB030650, AB030651, AB038153, AF010465, AF065893, AF065894, AF065895, AF065896, AF079519, AF106824, AF106825, AF106828, AF106829, AF106830, AF106831, AF106832, AF106833, AF106834, AF203442, AF203443, AF216747, AF257653, AH004645, AH008762, AX000904, AX000905, D49843, L12586, L12587, M27533, M83073, M83074, M83075, M83077, NM005191, S74541, S74540, S74695, S74696, U05593, U10925, U19833, U19840, U26832, U33063, U33208, U57755, U88622, X60958, Y08823, and Y09950. The antibodies are, e.g., polyclonal, monoclonal, chimeric, humanized, single chain, Fab fragments, fragments produced by an Fab expression library, or the like.

In another aspect, the invention provides a nucleic acid which comprises a unique subsequence in a nucleic acid selected from SEQ ID NOS:1–47, 95–173, and 253–262, wherein the unique subsequence is unique as compared to at least one (optionally all) nucleic acid corresponding to any of GenBank Nucleotide Accession Nos.: A92749, A92750, AA983817, AB026121, AB030650, AB030651, AB038153, AF010465, AF065893, AF065894, AF065895, AF065896, AF079519, AF106824, AF106825, AF106828, AF106829, AF106830, AF106831, AF106832, AF106833, AF106834, AF203442, AF203443, AF216747, AF257653, AH004645, AH008762, AX000904, AX000905, D49843, L12586, L12587, M27533, M83073, M83074, M83075, M83077, NM005191, S74541, S74540, S74695, S74696, U05593, U10925, U19833, U19840, U26832, U33063, U33208, U57755, U88622, X60958, Y08823, and Y09950. The invention also includes a polypeptide which comprises a unique subsequence in a polypeptide selected from: SEQ ID NOS:48–94, 174–252, 263–272, and 283–293, wherein the unique subsequence is unique as compared to at least one (optionally all) polypeptide encoded by any of GenBank Nucleotide Accession Nos. shown above.

The invention includes a target nucleic acid which hybridizes under stringent conditions to a unique coding oligonucleotide that encodes a unique subsequence in a polypeptide selected from SEQ ID NOS:48–94, 174–252, 263–272, and 283–293, wherein the unique subsequence is unique as compared to at least one (optionally all) polypeptide encoded by any of GenBank Nucleot. Access. Nos.: A92749, A92750, AA983817, AB026121, AB030650, AB030651, AB038153, AF010465, AF065893, AF065894, AF065895, AF065896, AF079519, AF106824, AF106825, AF106828, AF106829, AF106830, AF106831, AF106832, AF106833, AF106834, AF203442, AF203443, AF216747, AF257653, AH004645, AH008762, AX000904, AX000905, D49843, L12586, L12587, M27533, M83073, M83074, M83075, M83077, NM005191, S74541, S74540, S74695, S74696, U05593, U10925, U19833, U19840, U26832, U33063, U33208, U57755, U88622, X60958, Y08823, and Y09950.

The invention also includes compositions comprising any polypeptide and/or polynucleotide described herein in an excipient, preferably a pharmaceutically acceptable excipient. In one aspect, the invention provides compositions comprising an isolated or recombinant NCSM polypeptide comprising the amino acid sequence SEQ ID NOS:48–68, 174–221, 283–285, 290–293, or a costimulatory fragment thereof, wherein said costimulatory fragment has a CD28/CTLA-4 binding affinity ratio equal to or greater than the CD28/CTLA-4 binding affinity ratio of human B7-1, and a carrier or excipient. Compositions comprising an isolated or recombinant NCSM polypeptide comprising the amino acid sequence of SEQ ID NOS:69–92, 222–247, 263–272, 286–289, or a costimulatory fragment thereof, wherein said costimulatory fragment has a CTLA-4/CD28 binding affinity ratio equal to or greater than the CTLA-4/CD28 binding affinity ratio of human B7-1, and a carrier are also a feature of the invention.

The invention also includes an isolated or recombinant nucleic acid comprising a polynucleotide sequence encoding a polypeptide, where the polypeptide comprises an amino acid sequence which is substantially identical over at least 175 contiguous amino acids of any one of those NCSM polypeptide sequences listed. In various embodiments, the encoded polypeptide comprises at least about 150, 180, 190, 200, 210, 225, 230, 240, 250, 275, or 285 or more contiguous amino acid residues or substantially identical variants of any one of the polypeptide sequences listed, or encoded by any nucleic acid listed. These polypeptides can exist separately or as components of one of more fusion proteins.

The invention also includes a cell comprising any nucleic acid described herein, or which expresses any polypeptide or nucleic acid noted herein. In one embodiment, the cell expresses a polypeptide encoded by the nucleic acids herein.

The invention also includes a vector comprising any nucleic acid of the invention. The vector can comprise a plasmid, a cosmid, a phage, or a virus (or virus fragment); the vector can be, e.g., an expression vector, a cloning vector, a packaging vector, an integration vector, or the like. The invention also includes a cell transduced by the vector. The invention also includes compositions comprising any nucleic acid described herein, and an excipient, preferably a pharmaceutically acceptable excipient. Cells and transgenic animals that include any polypeptide or nucleic acid herein, e.g., produced by transduction of the vector, are also a feature of the invention.

The invention also includes compositions produced by digesting one or more nucleic acid described herein with a restriction endonuclease, an RNAse, or a DNAse; and, compositions produced by incubating one or more nucleic acid described herein in the presence of deoxyribonucleotide triphosphates and a nucleic acid polymerase, e.g., a thermostable polymerase.

The invention also includes compositions comprising two or more nucleic acids described herein. The composition may comprise a library of nucleic acids, where the library contains at least 5, 10, 20 or 50 or more nucleic acids.

In another aspect, the invention includes an isolated or recombinant polypeptide encoded by any nucleic acid described herein. In one embodiment, the polypeptide may comprise a sequence selected from any of SEQ ID NOS: 48–94, 174–252, 263–272, and 283–293. These sequences and fragments thereof can be present separately or as components of larger proteins such as fusion proteins.

Any polypeptide described herein optionally can effect or alter an immune response, e.g., either induce or inhibit proliferation or activation of T cells. In other embodiments, any polypeptide described above can bind preferentially either CD28 or CTLA-4 or both CD28 and CTLA-4 as described herein. In other embodiments, any polypeptide described herein optionally can enhance or limit cytokine production as described herein. Nucleotides encoding any such polypeptides having these properties are also a feature of the invention.

In one class of embodiments, any polypeptide described herein may further include a secretion signal or localization signal sequence, e.g., a signal sequence, an organelle targeting sequence, a membrane localization sequence, and the like. Any polypeptide described herein may further include a sequence that facilitates purification, e.g., an epitope tag (such as, e.g., a FLAG epitope), a polyhistidine tag, a GST fusion, and the like. The polypeptide optionally includes a methionine at the N-terminus. Any polypeptide described herein optionally includes one or more modified amino acid, such as a glycosylated amino acid, a PEG-ylated amino acid, a farnesylated amino acid, an acetylated amino acid, a biotinylated amino acid, a carboxylated amino acid, a phosphorylated amino acid, an acylated amino acid, or the like. Any polypeptide described herein further may be incorporated into a fusion protein, e.g., a fusion with an immunoglobulin (Ig) sequence.

Methods for producing the polypeptides of the invention are also included. One such method comprises introducing into a population of cells any NCSM nucleic acid described herein, which is operatively linked to a regulatory sequence effective to produce the encoded polypeptide, culturing the cells in a culture medium to produce the polypeptide, and isolating the polypeptide from the cells or from the culture medium. Another such method comprises introducing into a population of cells a recombinant expression vector comprising any NCSM nucleic acid described herein; administering the expression vector into a mammal; and isolating the polypeptide from the mammal or from a byproduct of the mammal.

The invention also includes a method of treating an autoimmune or allergic disorder in a subject in need of such treatment by administering to the subject an effective amount of any NCSM polypeptide (or polynucleotide or expression vector encoding such polypeptide) described herein. In various embodiments, the autoimmune disorder may be multiple sclerosis, rheumatoid arthritis, lupus erythematosus, type I diabetes, psoriasis and the like.

The invention also includes a method of enhancing or reducing an immune response in a subject, such as either by inducing or inhibiting T cell proliferation or activation, by administration of at least one NCSM polypeptide and/or NCSM polynucleotide described herein to a population of cells. The population of cells to which the nucleic acid or polypeptide is administered can be in vivo, ex vivo, or in vitro (e.g., cultured cells).

The invention also includes, in a method of treating a disorder or medical condition treatable by administration of NCSM polypeptides (or fragments thereof) or NCSM polynucleotides (or fragments thereof) to a subject, an improvement comprising administering to the subject an effective amount of a polypeptide and/or nucleic acid (or fragments thereof) described herein. The disorder, disease, or medical condition treatable by administration of NCSM polypeptides and/or nucleic acids (or fragments thereof, including soluble NCSMs and fusion proteins and vectors encoding them) may be, but is not limited to, e.g., chronic disease, autoimmune disorder, multiple sclerosis, rheumatoid arthritis, lupus erythematosus, type I diabetes, psoriasis, AIDS or AIDS-related complexes, allogeneic or xenogeneic grafts or transplants, a variety of cancers, viral and/or bacterial infections, or the like.

Also included is a method of therapeutic or prophylactic treatment of a disease or disorder in a subject in need of such treatment, comprising administering to the subject any NCSM polypeptide described herein and an immunogen specific for said disease or disorder, wherein the combined amount of polypeptide and immunogen is effective to prophylactically or therapeutically treat said disease or disorder.

In yet another aspect, the invention includes a method of enhancing, diminishing, modifying, or potentiating an immune response in a subject, comprising: directly administering to the subject a polynucleotide comprising any NCSM nucleic acid sequence described herein, operably linked to a promoter sequence that controls the expression of said nucleic acid sequence, said polynucleotide being present in an amount sufficient that uptake of said polynucleotide into one or more cells of the subject occurs and sufficient expression of said nucleic acid sequence results to produce an amount of a polypeptide effective to enhance, diminish, or modify an immune response.

In another aspect, the invention provides a method of modulating or altering a T-cell response specific to an antigen in a subject, the method comprising administering to the subject at least one polynucleotide sequence encoding a polypeptide comprising any of SEQ ID NOS:48–94, 174–252, 263–272 and 283–293 or fragment thereof, and a polynucleotide sequence encoding the antigen or antigenic fragment thereof, wherein each of the at least one polynucleotide sequences is expressed in the subject in an amount effective to modulate or alter a T cell response.

The invention also includes a method of modulating or altering an immune response in a subject, the method comprising introducing into cells of a tumor of the subject at least one polynucleotide sequence encoding a polypeptide comprising any of SEQ ID NOS:48–94, 174–252, 263–272 and 283–293 or fragment thereof, wherein the polypeptide or fragment thereof interacts with or binds to a T cell receptor when expressed in a subject, and wherein the at least one polynucleotide sequence is operably linked to a promoter for expression in the subject and is present in an amount sufficient that when expressed is effective to modulate or alter a T cell response.

In addition, the invention includes a vector comprising at least one polynucleotide sequence encoding a polypeptide comprising any of SEQ ID NOS:48–94, 174–252, 263–272 and 283–293 or fragment thereof, wherein the polypeptide or fragment thereof interacts with or binds to a T cell receptor when expressed in a subject, wherein the at least one polynucleotide sequence is operably linked to a promoter for expression in the subject and is present in an amount sufficient that when expressed is effective to modulate or alter a T cell response.

In another aspect, the invention provides vector comprising at least one polynucleotide sequence encoding a polypeptide comprising any of SEQ ID NOS:48–94, 174–252, 263–272 and 283–293 or fragment thereof, and a polynucleotide sequence encoding the antigen or antigenic fragment thereof, wherein the NCSM polypeptide or fragment thereof interacts with or binds to a T cell receptor when expressed in a subject, and wherein each of the at least one polynucleotide sequences is operably linked to a promoter for expression in the subject and is present in an amount sufficient that when expressed is effective to modulate or alter a T cell response.

In general, nucleic acids and proteins derived by mutation, recursive sequence recombination (RSR) or other alterations of the sequences herein are a feature of the invention. Similarly, those produced by recombination, including recursive sequence recombination, are a feature of the invention. Mutation and recombination methods using the nucleic acids described herein are a feature of the invention. For example, one method of the invention includes recombining one or more nucleic acids described herein with one or more additional nucleic acids (including, but not limited to those noted herein), the additional nucleic acid encoding a NCSM polypeptide, co-stimulatory homologue or subsequence thereof. The recombining steps are optionally performed in vivo, ex vivo, or in vitro. Also included in the invention are a recombinant nucleic acid produced by this method, a cell containing the recombinant nucleic acid, a nucleic acid library produced by this method comprising recombinant polynucleotides, and a population of cells containing the library comprising recombinant polynucleotides.

The invention also includes a method of designing or identifying agonists and antagonists of CD28 and CTLA-4 (which either enhance or inhibit signaling through CD28 or CTLA-4) based on the 3-dimensional structure of the polypeptides of the invention (e.g., SEQ ID NOS:48–94, 174–252, 263–272, and 283–293).

The invention also includes soluble polypeptides and proteins (including fusion polypeptides and proteins) and nucleic acids encoding such soluble polypeptides and proteins. The invention also includes the use of such polypeptides and proteins as therapeutics, prophylactics, and diagnostics in therapeutic treatment and/or prevention of a variety of diseases and conditions. Soluble polypeptides and proteins (and nucleic acids encoding them) include, e.g., extracellular domain (ECD) amino acid sequences of each NCSM (e.g., each CTLA-4 binding protein and CD28 binding protein) described herein (or fragments thereof) and nucleic acids encoding same, as well as constructs comprising, e.g., each of said ECD, or fragments thereof, with an Ig polypeptide sequence (or fragment or variant thereof) (and nucleotide sequences encoding same) as fusion proteins.

In another aspect, the invention provides a computer or computer readable medium comprising a database comprising a sequence record comprising one or more character strings corresponding to a nucleic acid or protein sequence selected from any of SEQ ID NOS:1–272 and 283–293. The invention further includes an integrated system comprising a computer or computer readable medium comprising a database comprising one or more sequence records, each comprising one or more character strings corresponding to a nucleic acid or protein sequence selected from any of SEQ ID NOS:1–272 and 283–293, the integrated system further comprising a user input interface allowing a user to selectively view one or more sequence record. Also provided are methods of using a computer system to present information pertaining to at least one of a plurality of sequence records stored in a database, said sequence records each comprising one or more character string corresponding to any of SEQ ID NOS:1–272 and 283–293.

These and other objects and features of the invention will become more fully apparent when the following detailed description is read in conjunction with the accompanying figures.

BRIEF DESCRIPTION OF THE FIGURES

FIG. 1A is a schematic representation of exemplary interactions between 1) a T cell receptor (TCR) and antigenic peptide presented in the groove of a major histocompatibility complex (MHC) molecule, and 2) a recombinant CD28BP polypeptide of the invention expressed on the surface of an antigen-presenting cell (APC) and a CD28 receptor on a T cell. FIG. 1B is a schematic representation of exemplary interactions between 1) a TCR and antigenic peptide presented in the groove of a MHC molecule, and 2) a recombinant CTLA-4BP polypeptide of the invention expressed on the surface of an APC and a CTLA-4 receptor on a T cell. The representation illustrates the principle by which recombinant polypeptides of the invention which preferentially bind the CD28 or CTLA-4 receptor effectuating enhanced or suppressed T cell activation.

Figure 2B:
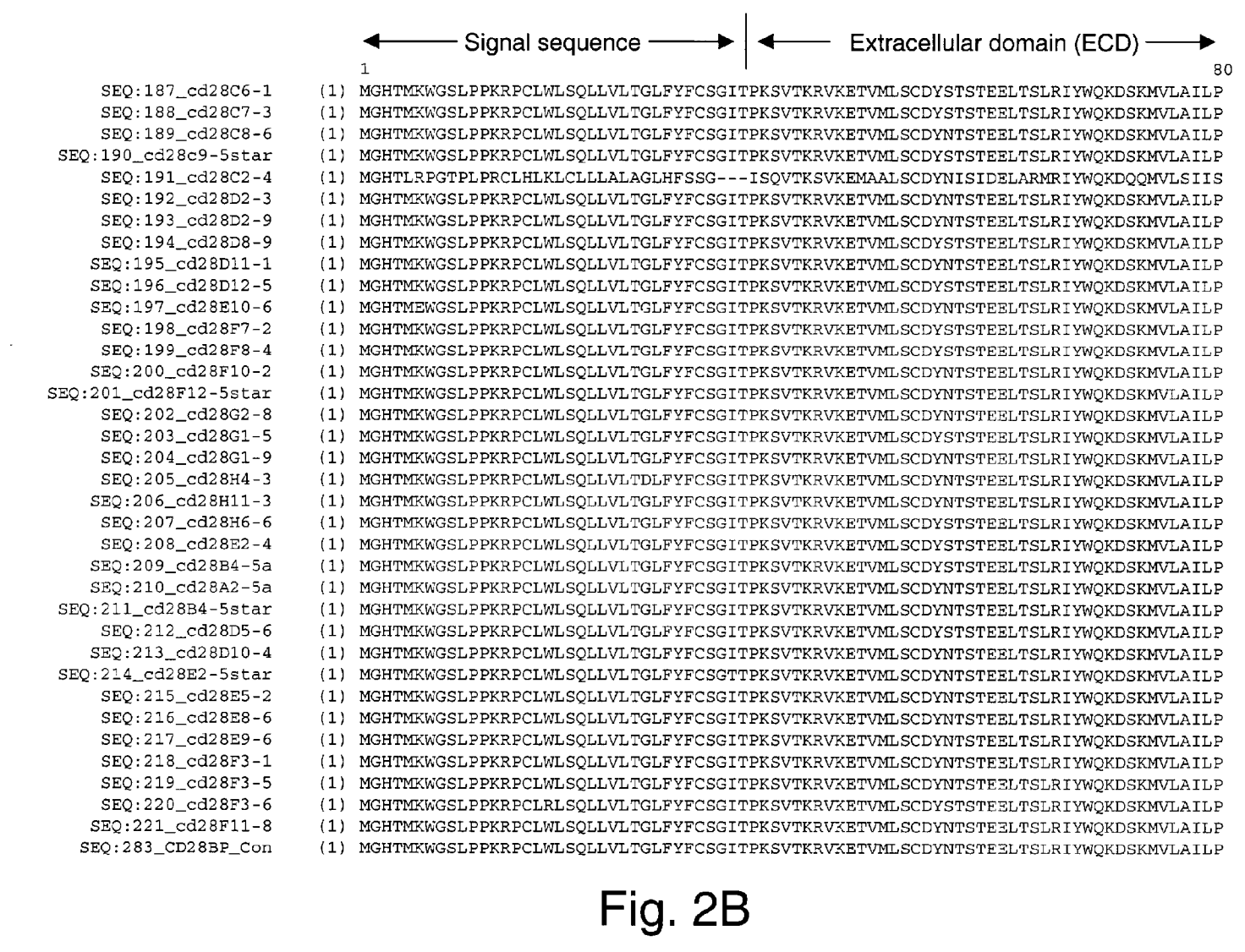
Figure 2F:
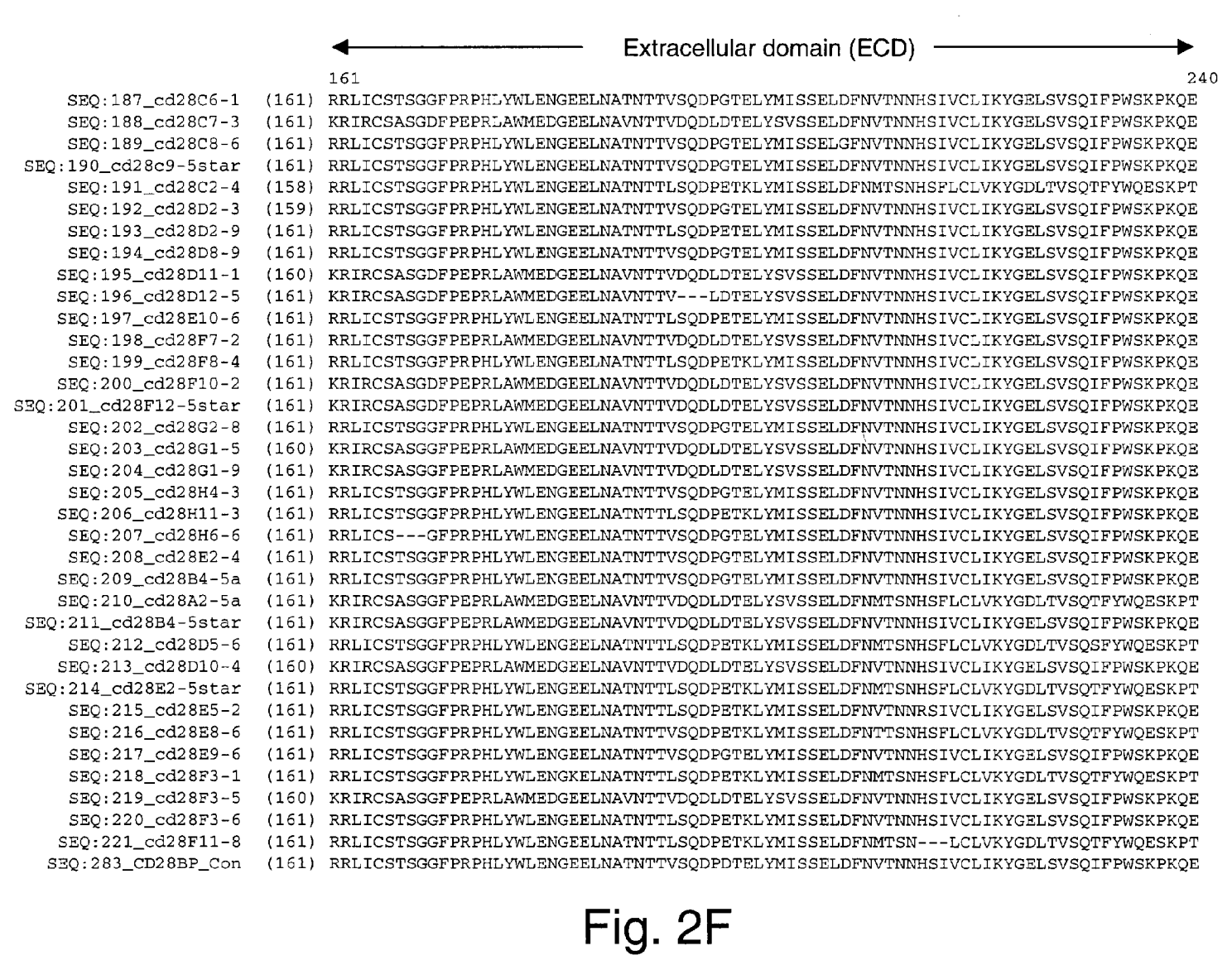

FIGS. 2A–2H depict an alignment of a naturally-occurring (i.e., wild-type) human B7-1 polypeptide sequence (SEQ ID NO:278) and exemplary CD28BP polypeptide sequences of the invention (SEQ ID NOS:48–68, SEQ ID NOS:174–221, and SEQ ID NO:283). The predicted boundaries between the signal peptide region, extracellular domain (ECD), transmembrane domain (TMD), and cytoplasmic domain (CD), based on corresponding boundaries in the hB7-1 sequence are shown at the top. The arrow positioned between the amino acid residues equivalent to amino acid residues 34–35 of SEQ ID NO:278, indicates the predicted boundary between the signal peptide region and the mature polypeptide region based on comparison with the hB7-1 sequence. SEQ ID NO:283 represents a "consensus sequence" of these aligned CD28BP sequences.

FIGS. 3A–3H illustrate an alignment of a naturally-occurring (i.e., wild-type) hB7-1 polypeptide sequence (SEQ ID NO:278 ) and exemplary CTLA-4BP polypeptide sequences of the invention (SEQ ID NOS:69–73, SEQ ID NOS:74–92, SEQ ID NO:222–252, and SEQ ID NO:286). The predicted boundaries between the signal peptide sequence, ECD, TMD, and CD, based on corresponding boundaries in the hB7-1 sequence are shown at the top. SEQ ID NO:286 represents a "consensus sequence" of these aligned CTLA-4BP sequences of the invention. Alignments shown in FIGS. 2A–2H and 3A–3H were prepared using the CLUSTALW multiple sequence alignment program, a part of the Vector NTI version 6 sequence analysis software package (Informax, Bethesda, Md.). CLUSTALW initially performs multiple pairwise comparisons between groups of sequences and then assembles the pairwise alignments into a multiple alignment based on homology. For the initial pairwise alignments, Gap Open and Gap Extension penalties were 10 and 0.1, respectively. For the multiple alignments, Gap Open penalty was 10, and the Gap Extension penalty was 0.05. The BLOSUM62 matrix was the protein weight matrix.

FIG. 6A is a schematic representation of an exemplary competitive FACS binding profile for a CTLA-4BP clone for soluble CD28-Ig receptor and soluble CTLA-4-Ig receptor. FIG. 6B is a schematic representation of an exemplary competitive FACS binding profile for a CD28BP clone for soluble CD28-Ig receptor and soluble CTLA-4-Ig receptor.

FIGS. 7A–7H are graphs showing competitive FACS binding profiles of WT human B7-1 (CD80), five CTLA-4BP clones, and HEK 293 cells (control) for soluble CD28-Ig receptor and soluble CTLA-4-Ig receptor.

FIGS. 8A–8B present schematic representations of the amino acid sequences of CD28BP-15 and CTLA-4 5x4-12c and the genealogy of these sequences.

FIG. 11C shows a graph depicting levels of IFN-gamma produced by co-culturing irradiated stable transfectants expressing CD28BP or hB7-1 or negative control cells transfected with an "empty" vector with purified human T cells.

FIG. 14A shows a representation of a fusion protein expressed by one such plasmid comprising a soluble WT human B7-1-ECD, including a signal sequence peptide (amino acid residues 1–34), ECD (amino acid residues 35–242), E-epitope tag (amino acid residues 243–259) and His-tag (amino acid residues 260–268). Numbering coincides with the ATG or Met. The amino acid residues positioned at the beginning and end of an exemplary ECD amino acid sequence are shown. FIG. 14B is an illustration of a fusion protein expressed by one such plasmid comprising a soluble WT hB7-1-ECD-Ig fusion protein, including the signal domain (amino acid residues 1–34), ECD domain (amino acid residues 35–242), Factor Xa (IGER), valine-threonine (VT) or (BsetII) glycine-valine-threonine (GVT) linker, and hinge CH2-CH3 (constant/heavy) region of the Fc domain of IgG1(e.g., GenBank Access. No. P01857 or X70421) (showing the initial amino acid residues corresponding to nucleic acid sequence shown at GenBank Accession No. X70421). The amino acid residues positioned at the beginning and end of an exemplary ECD amino acid sequence are shown. Optionally, other Ig molecules, or Ig Fc fragments thereof, can used to construct NCSM-Ig fusion proteins. Similar expression plasmids were constructed by substituting a nucleotide sequence encoding a NCSM polypeptide of the invention for the sequence encoding the hB7-1 ECD domain, and fusion proteins comprising NCSM-ECD sequences were generated from such plasmids. A nucleotide sequence encoding truncated ECD domain of hB7-1 or a NCSM polypeptide can also be substituted. The signal sequence may be the WT hB7-1 signal sequence or a recombinant signal sequence from a recombinant NCSM polynucleotide. The B7-1- or NCSM-ECD-Ig fusion protein may include Factor Xa cleavage site.

DETAILED DESCRIPTION OF THE INVENTION

Figure 2A:
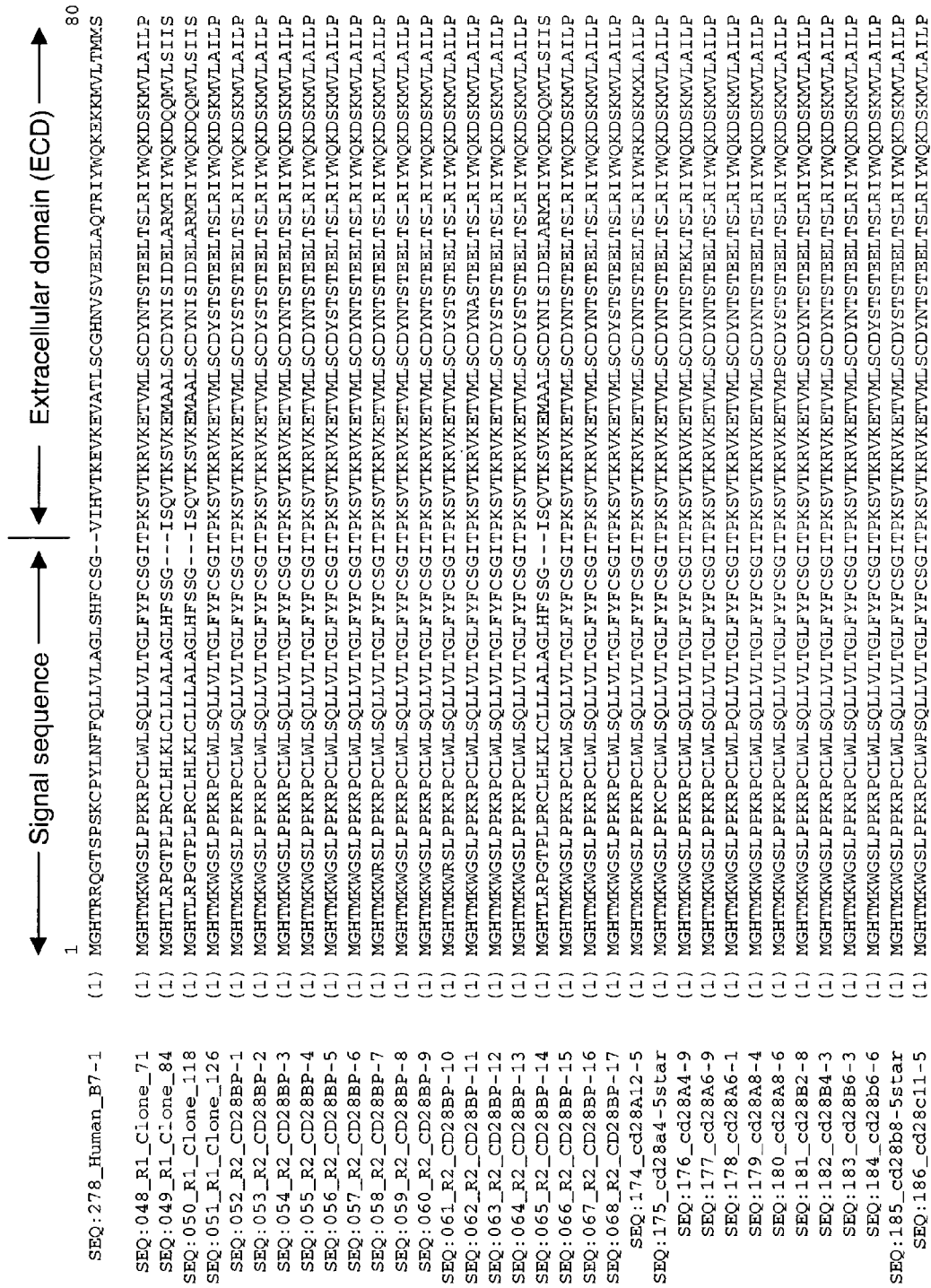
Figure 2H:
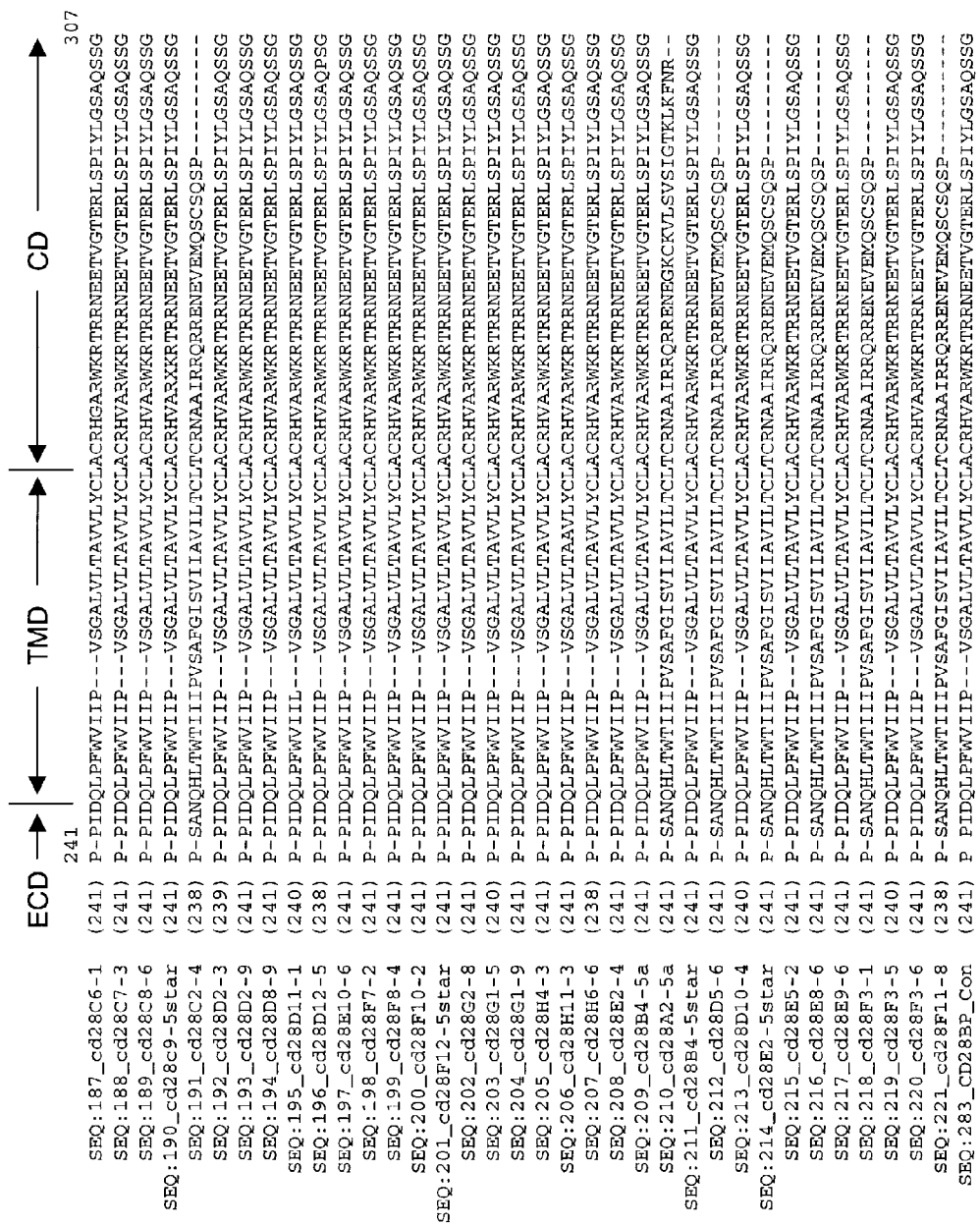
Figure 3H:
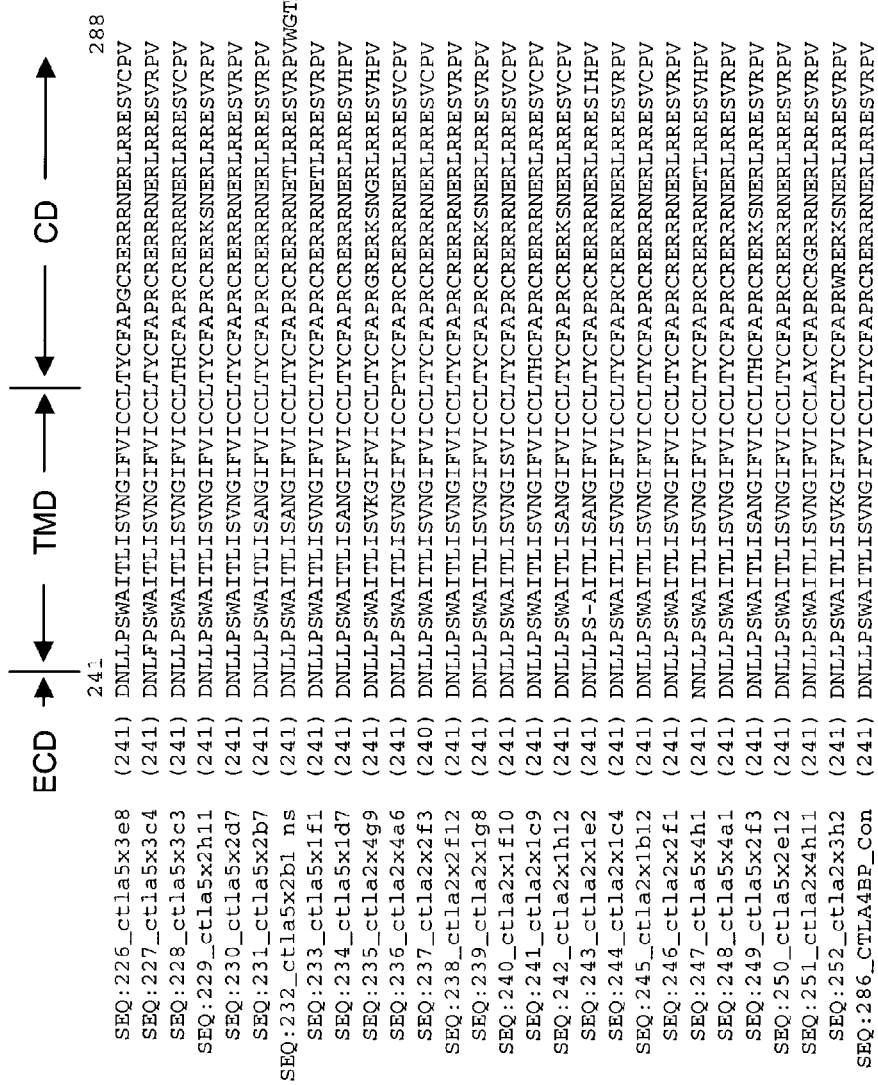
Figure 4:
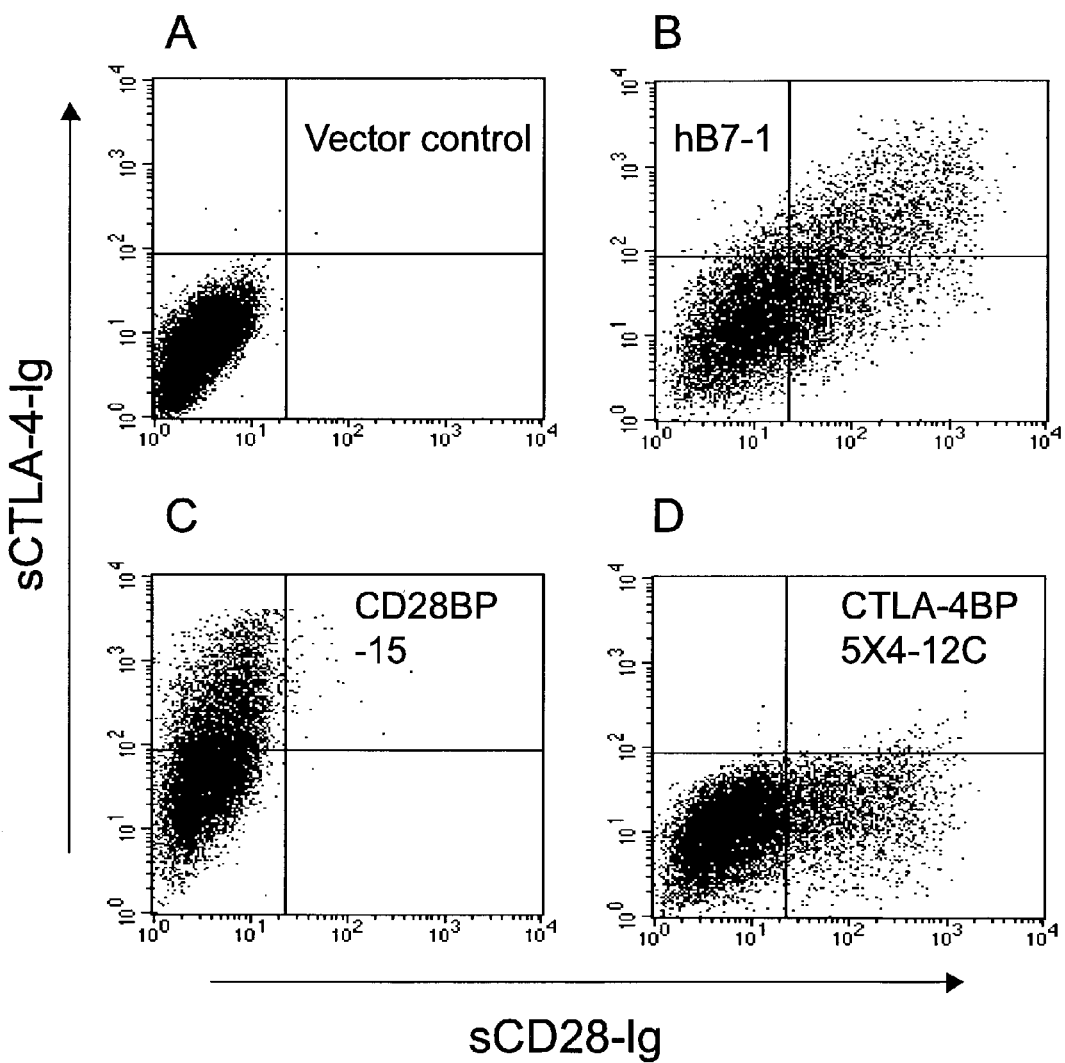
FIGS. 4A–4D presents graphs illustrating competitive FACS binding profiles of hB7-1, clone CD28BP-15, clone CTLA-4BP 5x4-12, and vector control for each of soluble CD28-Ig receptor and soluble CTLA-4-Ig receptor.
Figure 5:
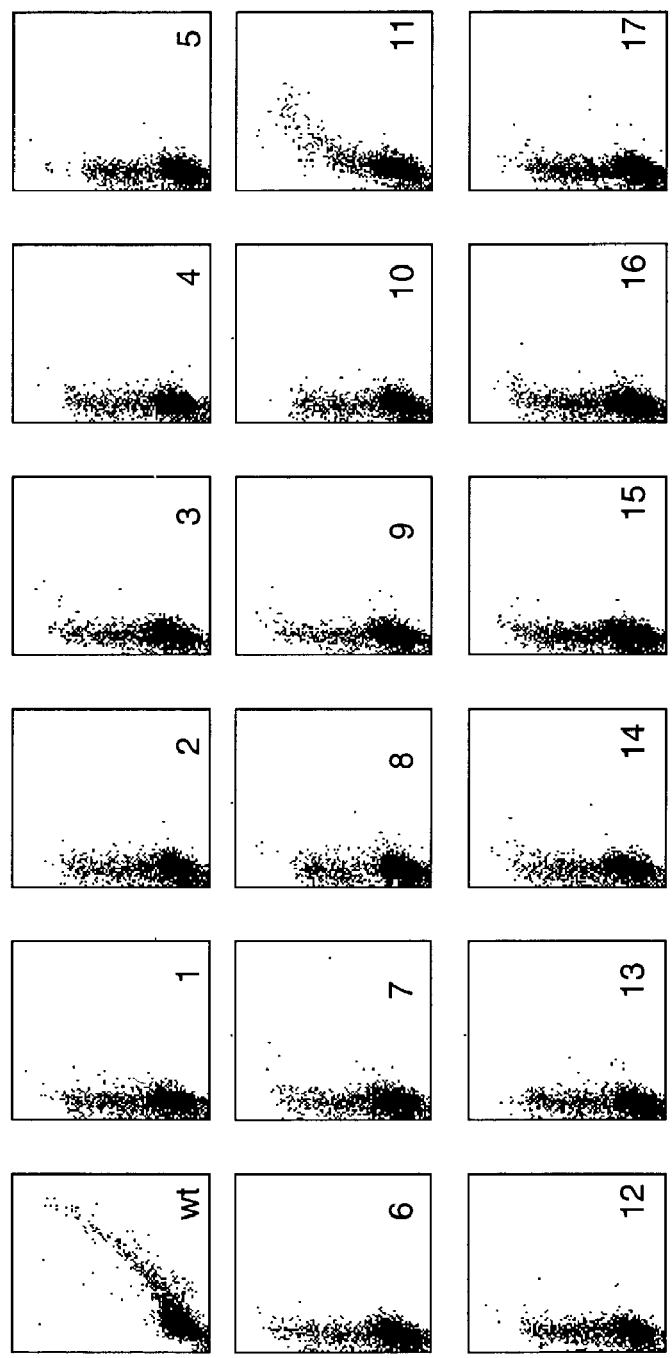
FIG. 5 presents graphs depicting competitive FACS binding profiles of seventeen Round 2 CD28BP clones for each of soluble CD28-Ig receptor and soluble CTLA-4-Ig receptor.

The expression of B7-1 has been shown to be an important mechanism of immune responses in mammals, including humans. It is believed that at least two signals are required for activation of T cells by antigen-bearing target cells:1) an antigen-specific signal, delivered through the T cell receptor (TCR); and 2) an antigen-independent or co-stimulatory signal that leads to the production of lymphokine products (Hodge et al. (1994) Cancer Res. 54:5552–5555). B7-1, which is typically expressed on antigen-presenting cells (APC), has been determined to be a ligand for two T cell surface antigen receptors: CD28 and CTLA-4. Both receptors are present on T cells, although they are expressed at different times and in different amounts. T cell activation is a prerequisite for all specific immune responses. However, if only one T cell activation signal is received by a T cell, activation will likely not occur, and anergy may result. For example, many tumor cells do not express B7-1. Consequently, even when a tumor expresses a potential rejection antigen, it is not likely that it will be able to activate an antitumor T cell response. Id. For T cell activation and enhanced immune response, an additional antigen-independent signal, such as from B7-1, is believed necessary.

The human CD28 receptor and human CTLA-4 receptor are naturally activated in human cells by B7-1. In some studies, the reported binding affinities of CTLA-4 and CD28 to WT hB7-1 were found to be about $0.2$–$0.4 \times 10^{-6}$ M and about $4 \times 10^{-6}$ M, respectively (van der Merwe et al. (1997) J. Exp. Med. 185:393; Ikemizu et al. (2000) Immunity 12:51). However, different studies have reported different binding affinities.

The amino acid sequence of full-length WT hB7-1 comprises 288 amino acids (GenBank Protein Access. No. P33681). The signal peptide (which is cleaved in the secreted form) comprises amino acid residues 1–34, the extracellular domain (ECD) comprises amino acid residues 35–242, the transmembrane domain comprises amino acid residues 243–263, and the cytoplasmic domain comprises amino acid residues 264–288. The mature form of hB7-1, which has a total of 254 amino acids, comprises amino acid residues 35–288 (the full-length sequence without the signal peptide), and begins with the amino acid sequence: valine-isoleucine-histidine-valine. If desired, the amino acids of the mature form can be numbered beginning with the Val of the Val-Ile-His-Val sequence, designating Val as the first residue (e.g., amino acid residues number 1–208). In another aspect, the ECD of hB7-1 comprises amino acid residues 1–208, the transmembrane domain comprises amino acid residues 209–235, and the cytoplasmic domain comprises amino acid residues 236–254 of the full-length mature hB7-1 sequence when numbered beginning with the Val of the Val-Ile-His-Val sequence as described above. See, e.g., U.S. Pat. No. 6,071,716. There are eight possible glycosylation sites (Asn-X-Ser/Thr) in hB7-1 ECD. The transmembrane domain includes at least 3 cysteine residues that may be involved in binding to other polypeptides or lipid derivatization. Id.

According to one study, the nucleic acid sequence of WT hB7-1 comprises 1491 base pairs and is set forth in U.S. Pat. No. 6,071,716 (see SEQ ID NO:1 therein). An alignment of the hB7-1 nucleic acid sequence with its corresponding full-length amino acid sequence is also shown in U.S. Pat. No. 6,071,716 (see SEQ ID NO:1 therein).

Using the nucleotide sequences of human B7-1 and other selected mammalian B7-1 molecules, we generated recombination nucleotides encoding recombinant chimeric co-stimulatory peptides molecules having altered properties as compared those of WT hB7. This embodiment and others are described in detail below. FIG. 1 illustrates an interaction between an NCSM molecule of the invention, as expressed of an APC cell, and corresponding receptor, expressed on a T cell.

Definitions

Unless otherwise defined herein or below in the remainder of the specification, all technical and scientific terms used herein have the same meaning as commonly understood by those of ordinary skill in the art to which the invention belongs.

A "polynucleotide sequence" is a nucleic acid which comprises a polymer of nucleic acid residues or nucleotides (A,C,T,U,G, etc. or naturally occurring or artificial nucleotide analogues), or a character string representing a nucleic acid, depending on context. Either the given nucleic acid or the complementary nucleic acid can be determined from any specified polynucleotide sequence.

A "polypeptide sequence" is a polymer of amino acids (a protein, polypeptide, etc., comprising amino acid residues) or a character string representing an amino acid polymer, depending on context. Given the degeneracy of the genetic code, one or more nucleic acids, or the complementary nucleic acids thereof, that encode a specific polypeptide sequence can be determined from the polypeptide sequence.

A nucleic acid, protein, peptide, polypeptide, or other component is "isolated" when it is partially or completely separated from components with which it is normally associated (other peptides, polypeptides, proteins (including complexes, e.g., polymerases and ribosomes which may accompany a native sequence), nucleic acids, cells, synthetic reagents, cellular contaminants, cellular components, etc.), e.g., such as from other components with which it is normally associated in the cell from which it was originally derived. A nucleic acid, polypeptide, or other component is isolated when it is partially or completely recovered or separated from other components of its natural environment such that it is the predominant species present in a composition, mixture, or collection of components (i.e., on a molar basis it is more abundant than any other individual species in the composition). In preferred embodiments, the preparation consists of more than about 70% or 75%, typically more than about 80%, or preferably more than about 90% of the isolated species.

In one aspect, a "substantially pure" or "isolated" nucleic acid (e.g., RNA or DNA), polypeptide, protein, or composition also means where the object species (e.g., nucleic acid or polypeptide) comprises at least about 50, 60, or 70 percent by weight (on a molar basis) of all macromolecular species present. A substantially pure or isolated composition can also comprise at least about 80, 90, or 95 percent by weight of all macromolecular species present in the composition. An isolated object species can also be purified to essential homogeneity (contaminant species cannot be detected in the composition by conventional detection methods) wherein the composition consists essentially of derivatives of a single macromolecular species. The term "purified" generally denotes that a nucleic acid, polypeptide, or protein gives rise to essentially one band in an electrophoretic gel. It typically means that the nucleic acid, polypeptide, or protein is at least about 50% pure, 60% pure, 70% pure, 75% pure, more preferably at least about 85% pure, and most preferably at least about 99% pure.

The term "isolated nucleic acid" may refer to a nucleic acid (e.g., DNA or RNA) that is not immediately contiguous with both of the coding sequences with which it is immediately contiguous (i.e., one at the 5' and one at the 3' end) in the naturally occurring genome of the organism from which the nucleic acid of the invention is derived. Thus, this term includes, e.g., a cDNA or a genomic DNA fragment produced by polymerase chain reaction (PCR) or restriction endonuclease treatment, whether such cDNA or genomic DNA fragment is incorporated into a vector, integrated into the genome of the same or a different species than the organism, including, e.g., a virus, from which it was originally derived, linked to an additional coding sequence to form a hybrid gene encoding a chimeric polypeptide, or independent of any other DNA sequences. The DNA may be double-stranded or single-stranded, sense or antisense.

The term "recombinant" when used with reference, e.g., to a cell, nucleotide, vector, protein, or polypeptide typically indicates that the cell, nucleotide, or vector has been modified by the introduction of a heterologous (or foreign) nucleic acid or the alteration of a native nucleic acid, or that the protein or polypeptide has been modified by the introduction of a heterologous amino acid, or that the cell is derived from a cell so modified. Recombinant cells express nucleic acid sequences (e.g., genes) that are not found in the native (non-recombinant) form of the cell or express native nucleic acid sequences (e.g., genes) that would be abnormally expressed under-expressed, or not expressed at all. The term "recombinant" when used with reference to a cell indicates that the cell replicates a heterologous nucleic acid, or expresses a peptide or protein encoded by a heterologous nucleic acid. Recombinant cells can contain genes that are not found within the native (non-recombinant) form of the cell. Recombinant cells can also contain genes found in the native form of the cell wherein the genes are modified and re-introduced into the cell by artificial means. The term also encompasses cells that contain a nucleic acid endogenous to the cell that has been modified without removing the nucleic acid from the cell; such modifications include those obtained by gene replacement, site-specific mutation, and related techniques.

A "recombinant polynucleotide" or a "recombinant polypeptide" is a non-naturally occurring polynucleotide or polypeptide that includes nucleic acid or amino acid sequences, respectively, from more than one source nucleic acid or polypeptide, which source nucleic acid or polypeptide can be a naturally occurring nucleic acid or polypeptide, or can itself have been subjected to mutagenesis or other type of modification. A nucleic acid or polypeptide may be deemed "recombinant" when it is artificial or engineered, or derived from an artificial or engineered polypeptide or nucleic acid. A recombinant nucleic acid (e.g., DNA or RNA) can be made by the combination (e.g., artificial combination) of at least two segments of sequence that are not typically included together, not typically associated with one another, or are otherwise typically separated from one another. A recombinant nucleic acid can comprise a nucleic acid molecule formed by the joining together or combination of nucleic acid segments from different sources and/or artificially synthesized. A "recombinant polypeptide" (or "recombinant protein") often refers to a polypeptide (or protein) that results from a cloned or recombinant nucleic acid or gene. The source polynucleotides or polypeptides from which the different nucleic acid or amino acid sequences are derived are sometimes homologous (i.e., have, or encode a polypeptide that encodes, the same or a similar structure and/or function), and are often from different isolates, serotypes, strains, species, of organism or from different disease states, for example.

The term "recombinantly produced" refers to an artificial combination usually accomplished by either chemical synthesis means, recursive sequence recombination of nucleic acid segments or other diversity generation methods (such as, e.g., shuffling) of nucleotides, or manipulation of isolated segments of nucleic acids, e.g., by genetic engineering techniques known to those of ordinary skill in the art. "Recombinantly expressed" typically refers to techniques for the production of a recombinant nucleic acid in vitro and transfer of the recombinant nucleic acid into cells in vivo, in vitro, or ex vivo where it may be expressed or propagated.

A "recombinant expression cassette" or simply an "expression cassette" is a nucleic acid construct, generated recombinantly or synthetically, with nucleic acid elements that are capable of effecting expression of a structural gene in hosts compatible with such sequences. Expression cassettes include at least promoters and optionally, transcription termination signals. Typically, the recombinant expression cassette includes a nucleic acid to be transcribed (e.g., a nucleic acid encoding a desired polypeptide), and a promoter. Additional factors necessary or helpful in effecting expression may also be used as described herein. For example, an expression cassette can also include nucleotide sequences that encode a signal sequence that directs secretion of an expressed protein from the host cell. Transcription termination signals, enhancers, and other nucleic acid sequences that influence gene expression, can also be included in an expression cassette.

An "immunogen" refers to a substance capable of provoking an immune response, and includes, e.g., antigens, autoantigens that play a role in induction of autoimmune diseases, and tumor-associated antigens expressed on cancer cells. An immune response generally refers to the development of a cellular or antibody-mediated response to an agent, such as an antigen or fragment thereof or nucleic acid encoding such agent. In some instances, such a response comprises a production of at least one or a combination of CTLs, B cells, or various classes of T cells that are directed specifically to antigen-presenting cells expressing the antigen of interest.

"Tolerance" refers to a state of diminished or lack of immunological responsiveness. Tolerance typically defines an absent or diminished or lessened capacity of a subject to mount an immune response against a given antigen, usually the result of, e.g., contact between the subject and a target antigen under non-immunizing conditions.

"Anergy" refers to a state of diminished reactivity to one or more antigens. For example, anergy state is often characterized by diminished T cell responses, e.g., proliferation or IL-2 production, when specific T cells are restimulated under otherwise stimulatory conditions.

An "antigen" refers to a substance that is capable of eliciting the formation of antibodies in a host or generating a specific population of lymphocytes reactive with that substance. Antigens are typically macromolecules (e.g., proteins and polysaccharides) that are foreign to the host.

A "subsequence" or "fragment" is any portion of an entire sequence, up to and including the complete sequence. Thus, a "subsequence" refers to a sequence of nucleic acids or amino acids that comprises a part of a longer sequence of nucleic acids (e.g., polynucleotide) or amino acids (e.g., polypeptide) respectively.

An "adjuvant" refers to a substance that enhances an antigen's immune-stimulating properties or the pharmacological effect(s) of a drug. An adjuvant may non-specifically enhance the immune response to an antigen. "Freund's Complete Adjuvant," for example, is an emulsion of oil and water containing an immunogen, an emulsifying agent and mycobacteria. Another example, "Freund's incomplete adjuvant," is the same, but without mycobacteria.

Numbering of a given amino acid polymer or nucleotide polymer "corresponds to numbering" of a selected amino acid polymer or nucleic acid polymer when the position of any given polymer component (e.g., amino acid residue, nucleotide residue) is designated by reference to the same or an equivalent residue position in the selected amino acid or nucleotide polymer, rather than by the actual position of the component in the given polymer. Thus, for example, the numbering of a given amino acid position in a given polypeptide sequence corresponds to the same or equivalent amino acid position in a selected polypeptide sequence used as a reference sequence.

A vector is a component or composition for facilitating cell transduction or transfection by a selected nucleic acid, or expression of the nucleic acid in the cell. Vectors include, e.g., plasmids, cosmids, viruses, YACs, bacteria, polylysine, etc. An "expression vector" is a nucleic acid construct or sequence, generated recombinantly or synthetically, with a series of specific nucleic acid elements that permit transcription of a particular nucleic acid in a host cell. The expression vector can be part of a plasmid, virus, or nucleic acid fragment. The expression vector typically includes a nucleic acid to be transcribed operably linked to a promoter. The nucleic acid to be transcribed is typically under the direction or control of the promoter.

"Substantially the entire length of a polynucleotide sequence" or "substantially the entire length of a polypeptide sequence" refers to at least about 50%, generally at least about 60%, 70%, or 75%, usually at least about 80%, or typically at least about 90%, 91%, 92%, 93%, 94%, 95%, 96%, 97%, 98%, 99%, 99.5% or more of a length of a polynucleotide sequence or polypeptide sequence.

"Naturally occurring" as applied to an object refers to the fact that the object can be found in nature as distinct from being artificially produced by man. For example, a polypeptide or polynucleotide sequence that is present in an organism (including viruses, bacteria, protozoa, insects, plants or mammalian tissue) that can be isolated from a source in nature and which has not been intentionally modified by man in the laboratory is naturally occurring. Non-naturally occurring as applied to an object means that the object is not naturally-occurring—i.e., the object cannot be found in nature as distinct from being artificially produced by man.

The term "immunoassay" includes an assay that uses an antibody or immunogen to bind or specifically bind an antigen. The immunoassay is typically characterized by the use of specific binding properties of a particular antibody to isolate, target, and/or quantify the antigen.

The term "homology" generally refers to the degree of similarity between two or more structures. The term "homologous sequences" refers to regions in macromolecules that have a similar order of monomers. When used in relation to nucleic acid sequences, the term "homology" refers to the degree of similarity between two or more nucleic acid sequences (e.g., genes) or fragments thereof. Typically, the degree of similarity between two or more nucleic acid sequences refers to the degree of similarity of the composition, order, or arrangement of two or more nucleotide bases (or other genotypic feature) of the two or more nucleic acid sequences. The term "homologous nucleic acids" generally refers to nucleic acids comprising nucleotide sequences having a degree of similarity in nucleotide base composition, arrangement, or order. The two or more nucleic acids may be of the same or different species or group. The term "percent homology" when used in relation to nucleic acid sequences, refers generally to a percent degree of similarity between the nucleotide sequences of two or more nucleic acids.

When used in relation to polypeptide (or protein) sequences, the term "homology" refers to the degree of similarity between two or more polypeptide (or protein) sequences (e.g., genes) or fragments thereof. Typically, the degree of similarity between two or more polypeptide (or protein) sequences refers to the degree of similarity of the composition, order, or arrangement of two or more amino acid of the two or more polypeptides (or proteins). The two or more polypeptides (or proteins) may be of the same or different species or group. The term "percent homology" when used in relation to polypeptide (or protein) sequences, refers generally to a percent degree of similarity between the amino acid sequences of two or more polypeptide (or protein) sequences. The term "homologous polypeptides" or "homologous proteins" generally refers to polypeptides or proteins, respectively, that have amino acid sequences and functions that are similar. Such homologous polypeptides or proteins may be related by having amino acid sequences and functions that are similar, but are derived or evolved from different or the same species using the techniques described herein.

The term "subject" as used herein includes, but is not limited to, an organism; a mammal, including, e.g., a human, non-human primate (e.g., baboon, orangutan, monkey), mouse, pig, cow, goat, cat, rabbit, rat, guinea pig, hamster, horse, monkey, sheep, or other non-human mammal; a non-mammal, including, e.g., a non-mammalian vertebrate, such as a bird (e.g., a chicken or duck) or a fish, and a non-mammalian invertebrate.

The term "pharmaceutical composition" means a composition suitable for pharmaceutical use in a subject, including an animal or human. A pharmaceutical composition generally comprises an effective amount of an active agent and a carrier, including, e.g., a pharmaceutically acceptable carrier.

The term "effective amount" means a dosage or amount sufficient to produce a desired result. The desired result may comprise an objective or subjective improvement in the recipient of the dosage or amount.

A "prophylactic treatment" is a treatment administered to a subject who does not display signs or symptoms of a disease, pathology, or medical disorder, or displays only early signs or symptoms of a disease, pathology, or disorder, such that treatment is administered for the purpose of diminishing, preventing, or decreasing the risk of developing the disease, pathology, or medical disorder. A prophylactic treatment functions as a preventative treatment against a disease or disorder. A "prophylactic activity" is an activity of an agent, such as a nucleic acid, vector, gene, polypeptide, protein, substance, or composition thereof that, when administered to a subject who does not display signs or symptoms of pathology, disease or disorder, or who displays only early signs or symptoms of pathology, disease, or disorder, diminishes, prevents, or decreases the risk of the subject developing a pathology, disease, or disorder. A "prophylactically useful" agent or compound (e.g., nucleic acid or polypeptide) refers to an agent or compound that is useful in diminishing, preventing, treating, or decreasing development of pathology, disease or disorder.

A "therapeutic treatment" is a treatment administered to a subject who displays symptoms or signs of pathology, disease, or disorder, in which treatment is administered to the subject for the purpose of diminishing or eliminating those signs or symptoms of pathology, disease, or disorder. A "therapeutic activity" is an activity of an agent, such as a nucleic acid, vector, gene, polypeptide, protein, substance, or composition thereof, that eliminates or diminishes signs or symptoms of pathology, disease or disorder, when administered to a subject suffering from such signs or symptoms. A "therapeutically useful" agent or compound (e.g., nucleic acid or polypeptide) indicates that an agent or compound is useful in diminishing, treating, or eliminating such signs or symptoms of a pathology, disease or disorder.

The term "gene" broadly refers to any segment of DNA associated with a biological function. Genes include coding sequences and/or regulatory sequences required for their expression. Genes also include non-expressed DNA nucleic acid segments that, e.g., form recognition sequences for other proteins (e.g., promoter, enhancer, or other regulatory regions). Genes can be obtained from a variety of sources, including cloning from a source of interest or synthesizing from known or predicted sequence information, and may include sequences designed to have desired parameters.

Generally, the nomenclature used hereafter and the laboratory procedures in cell culture, molecular genetics, molecular biology, nucleic acid chemistry, and protein chemistry described below are those well known and commonly employed by those of ordinary skill in the art. Standard techniques, such as described in Sambrook et al., *Molecular Cloning—A Laboratory Manual* (2nd Ed.), Vols. 1–3, Cold Spring Harbor Laboratory, Cold Spring Harbor, N.Y., 1989 (hereinafter "Sambrook") and *Current Protocols in Molecular Biology*, F. M. Ausubel et al., eds., Current Protocols, a joint venture between Greene Publishing Associates, Inc. and John Wiley & Sons, Inc. (1994, supplemented through 1999) (hereinafter "Ausubel"), are used for recombinant nucleic acid methods, nucleic acid synthesis, cell culture methods, and transgene incorporation, e.g., electroporation, injection, gene gun, impressing through the skin, and lipofection. Generally, oligonucleotide synthesis and purification steps are performed according to specifications. The techniques and procedures are generally performed according to conventional methods in the art and various general references which are provided throughout this document. The procedures therein are believed to be well known to those of ordinary skill in the art and are provided for the convenience of the reader.

As used herein, an "antibody" refers to a protein comprising one or more polypeptides substantially or partially encoded by immunoglobulin genes or fragments of immunoglobulin genes. The term antibody is used to mean whole antibodies and binding fragments thereof. The recognized immunoglobulin genes include the kappa, lambda, alpha, gamma, delta, epsilon and mu constant region genes, as well as myriad immunoglobulin variable region genes. Light chains are classified as either kappa or lambda. Heavy chains are classified as gamma, mu, alpha, delta, or epsilon, which in turn define the immunoglobulin classes, IgG, IgM, IgA, IgD and IgE, respectively. A typical immunoglobulin (e.g., antibody) structural unit comprises a tetramer. Each tetramer is composed of two identical pairs of polypeptide chains, each pair having one "light" (about 25 KDa) and one "heavy" chain (about 50–70 KDa). The N-terminus of each chain defines a variable region of about 100 to 110 or more amino acids primarily responsible for antigen recognition. The terms variable light chain (VL) and variable heavy chain (VH) refer to these light and heavy chains, respectively.

Antibodies exist as intact immunoglobulins or as a number of well characterized fragments produced by digestion with various peptidases. Thus, for example, pepsin digests an antibody below the disulfide linkages in the hinge region to produce F(ab)'2, a dimer of Fab which itself is a light chain joined to VH-CH1 by a disulfide bond. The F(ab)'2 may be reduced under mild conditions to break the disulfide linkage in the hinge region thereby converting the (Fab')2 dimer into an Fab' monomer. The Fab' monomer is essentially an Fab with part of the hinge region. The Fc portion of the antibody molecule corresponds largely to the constant region of the immunoglobulin heavy chain, and is responsible for the antibody's effector function (see, *Fundamental Immunology*, W. E. Paul, ed., Raven Press, N.Y. (1993), for a more detailed description of other antibody fragments). While various antibody fragments are defined in terms of the digestion of an intact antibody, one of skill will appreciate that such Fab' fragments may be synthesized de novo either chemically or by utilizing recombinant DNA methodology. Thus, the term antibody, as used herein also includes antibody fragments either produced by the modification of whole antibodies or synthesized de novo using recombinant DNA methodologies.

Antibodies also include single-armed composite monoclonal antibodies, single chain antibodies, including single chain Fv (sFv) antibodies in which a variable heavy and a variable light chain are joined together (directly or through a peptide linker) to form a continuous polypeptide, as well as diabodies, tribodies, and tetrabodies (Pack et al. (1995) *J Mol Biol* 246:28; *Biotechnol* 11:1271; and *Biochemistry* 31:1579). The antibodies are, e.g., polyclonal, monoclonal, chimeric, humanized, single chain, Fab fragments, fragments produced by an Fab expression library, or the like.

The term "epitope" means a protein determinant capable of specific binding to an antibody. Epitopes usually consist of chemically active surface groupings of molecules such as amino acids or sugar side chains and usually have specific three dimensional structural characteristics, as well as specific charge characteristics. Conformational and nonconformational epitopes are distinguished in that the binding to the former but not the latter is lost in the presence of denaturing solvents.

An "antigen-binding fragment" of an antibody is a peptide or polypeptide fragment of the antibody that binds an antigen. An antigen-binding site is formed by those amino acids of the antibody that contribute to, are involved in, or affect the binding of the antigen. See Scott, T. A. and Mercer, E. I., *Concise Encyclopedia: Biochemistry and Molecular Biology* (de Gruyter, 3d ed. 1997), and Watson, J. D. et al., *Recombinant DNA* (2d ed. 1992) [hereinafter "Watson, Recombinant DNA"], each of which is incorporated herein by reference in its entirety for all purposes.

The term "screening" describes, in general, a process that identifies optimal molecules of the present invention, such as, e.g., the NCSM polypeptide and proteins, fragments and homologues thereof, and related fusion polypeptides and proteins including the same, nucleic acids encoding all such molecules. Several properties of these respective molecules can be used in selection and screening, for example, an ability of a respective molecule to bind to a receptor, to alter an immune response, e.g., induce or inhibit a desired immune response, in a test system or an in vitro, ex vivo or in vivo application (e.g., induce or inhibit a T cell proliferation response in conjunction with costimulation of T cell receptor/CD3 (by, e.g., an antigen or antiCD3 antibody)), or to bind a first receptor with equal, greater, or less binding affinity relative to a second receptor compared to the binding affinity of a control molecule (e.g., a wild-type B7-1 or co-stimulatory molecule) for the first and second receptors, as measured by the respective molecule's first receptor/second receptor binding affinity ratio (or its reciprocal), compared to the control molecule's first receptor/second receptor binding affinity ratio. In the case of antigens, several properties of the antigen can be used in selection and screening including antigen expression, folding, stability, immunogenicity and presence of epitopes from several related antigens. Selection is a form of screening in which identification and physical separation are achieved simultaneously by expression of a selection marker, which, in some genetic circumstances, allows cells expressing the marker to survive while other cells die (or vice versa). Screening markers include, for example, luciferase, beta-galactosidase and green fluorescent protein, and the like. Selection markers include drug and toxin resistance genes, and the like. Because of limitations in studying primary immune responses in vitro, in vivo or ex vivo studies are particularly useful screening methods. In these studies, genetic vaccines or expression vectors that include sequences encoding one or more respective NCSM polypeptides, are first introduced to test animals, and the immune responses are subsequently studied by analyzing protective immune responses or by studying the quality or strength of the induced immune response using lymphoid cells derived from the immunized animal. Alternatively, the NCSM polypeptide itself or a soluble form thereof (e.g., the ECD of the polypeptide or a fragment thereof alone or in a fusion protein) is introduced to the test animal. Although spontaneous selection can and does occur in the course of natural evolution, in the present methods selection is performed by man.

A "specific binding affinity" between two molecules, e.g., a ligand and a receptor, means a preferential binding of one molecule for another in a mixture of molecules. The binding of the molecules is typically considered specific if the binding affinity is about $1\times10^2$ $M^{-1}$ to about $1\times10^7$ $M^{-1}$ (i.e., about $10^{-2-10-7}$ M) or greater.

A "binding affinity ratio" refers to a relative ratio of the binding affinity of a molecule of interest (e.g., a recombinant ligand, such as a NSCM polypeptide) for a first molecule (e.g., a first receptor, such as CD28 receptor) to the binding affinity of the same molecule of interest to a second molecule (e.g., a second receptor, such as CTLA-4 receptor). In one aspect, the relative binding affinity ratio may be determined by visual inspection, such as by, e.g., examining a FACS binding profile that displays the binding affinity profile of the molecule of interest to both receptors, and evaluating the degree of relative binding of the molecule of interest to each of the first and second receptors. The results of this determination can be compared with a similar examination and evaluation of a FACS binding affinity profile displaying the binding affinity of a control molecule (e.g., wild-type ligand, such as a WT human, primate, or mammalian B7-1) to both receptors, wherein the degree of relative binding of the control molecule to each of the receptors is evaluated. These and other procedures described below can be used to determine a CD28/CTLA-4 binding affinity ratio for a CD28BP polypeptide of the present invention and a CTLA-4/CD28 binding affinity ratio for a CTLA-4BP polypeptide of the present invention. Alternatively, a binding affinity ratio can be determined by making a ratio between a quantitative measurement of the binding affinity of the molecule of interest (e.g., ligand) for the first receptor and a quantitative measurement of the binding affinity of the molecule of interest for the second receptor using known procedures for measuring binding affinities.

For example, known methods for measuring the binding affinity of human (or other mammalian) B7-1 for each of CD28 and CTLA-4 receptor can be used.

An "exogenous" nucleic acid," "exogenous DNA segment," "heterologous sequence," or "heterologous nucleic acid," as used herein, is one that originates from a source foreign to the particular host cell, or, if from the same source, is modified from its original form. Thus, a heterologous gene in a host cell includes a gene that is endogenous to the particular host cell, but has been modified. Modification of a heterologous sequence in the applications described herein typically occurs through the use of recursive sequence recombination. The terms refer to a DNA segment which is foreign or heterologous to the cell, or homologous to the cell but in a position within the host cell nucleic acid in which the element is not ordinarily found. Exogenous DNA segments are expressed to yield exogenous polypeptides.

The term "nucleic acid" refers to deoxyribonucleotides or ribonucleotides and polymers thereof in either single- or double-stranded form. Unless specifically limited, the term encompasses nucleic acids containing known analogues of natural nucleotides which have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions) and complementary sequences and as well as the sequence explicitly indicated. Specifically, degenerate codon substitutions may be achieved by generating sequences in which the third position of one or more selected (or all) codons is substituted with mixed-base and/or deoxyinosine residues (Batzer et al. (1991) *Nucleic Acid Res* 19:5081; Ohtsuka et al. (1985) *J Biol Chem* 260:2605–2608; Cassol et al. (1992); Rossolini et al. (1994) *Mol Cell Probes* 8:91–98). The term nucleic acid is used interchangeably with gene, cDNA, and mRNA encoded by a gene.

"Nucleic acid derived from a gene" refers to a nucleic acid for whose synthesis the gene, or a subsequence thereof, has ultimately served as a template. Thus, an mRNA, a cDNA reverse transcribed from an mRNA, an RNA transcribed from that cDNA, a DNA amplified from the cDNA, an RNA transcribed from the amplified DNA, etc., are all derived from the gene and detection of such derived products is indicative of the presence and/or abundance of the original gene and/or gene transcript in a sample.

A nucleic acid is "operably linked" when it is placed into a functional relationship with another nucleic acid sequence. For instance, a promoter or enhancer is operably linked to a coding sequence if it increases the transcription of the coding sequence. Operably linked means that the DNA sequences being linked are typically contiguous and, where necessary to join two protein coding regions, contiguous and in reading frame. However, since enhancers generally function when separated from the promoter by several kilobases and intronic sequences may be of variable lengths, some polynucleotide elements may be operably linked but not contiguous.

The term "cytokine" includes, for example, interleukins, interferons, chemokines, hematopoietic growth factors, tumor necrosis factors and transforming growth factors. In general these are small molecular weight proteins that regulate maturation, activation, proliferation, and differentiation of cells of the immune system.

Various additional terms are defined or otherwise characterized herein.

Polynucleotides of the Invention

NCSM Polynucleotide Sequences

The invention provides isolated or recombinant NCSM polypeptides and fragments thereof, and isolated or recombinant polynucleotides encoding said polypeptides and fragments thereof. The term "NCSM polynucleotide" is intended throughout to include nucleic acid fragments, homologues, and variants of the polynucleotide sequences specifically disclosed herein unless otherwise noted.

In one aspect, the polynucleotides and polypeptides of the invention were made in two rounds of recursive sequence recombination using DNA recombination methods and formats described below. In preparation, prior to the rounds, cDNAs encoding, e.g., primate (rhesus monkey, baboon, and orangutan), cow, cat, and rabbit, B7-1 related sequences were cloned from their respective species, either from cell lines or peripheral blood. The cDNAs of the invention encoding baboon B7-1 and orangutan B7-1 are examples of previously unknown WT B7-1 polynucleotides. Baboon and orangutan B7-1 have CD28 and CTLA-4 binding properties and T cell proliferation properties similar to those of hB7-1 (data not shown). The polynucleotide sequences encoding baboon (SEQ ID NO:46) and orangutan (SEQ ID NO:47) B7-1, corresponding baboon B7-1 (SEQ ID NO:93) and orangutan (SEQ ID NO:94) B7-1 polypeptides, and homologues, fragments (e.g., ECD), fusion proteins thereof, are aspects of the invention.

In Round 1, the cDNAs encoding human, primate, cow, cat, and rabbit B7-1 were recursively recombined to form libraries comprising two or more recombinant polynucleotides. Other methods for obtaining libraries of recombinant polynucleotides (including NCSM polynucleotides) and/or for obtaining diversity in nucleic acids used as the substrates for recursive sequence recombination are also described infra. The libraries of Round 1 were initially screened via three methods. An initial screening sorted the pooled recombined clones based on preferential binding ability to soluble CD28 and CTLA-4 receptor fusion proteins. A second screening selected individual clones based on the ability to bind to either CD28 or CTLA-4. A third screening tested the individual clones from the second screen based on the ability to induce or inhibit T cell proliferation in conjunction with costimulation of T cell receptor/CD3 (by, e.g., an antigen or antiCD3 Ab). Exemplary NCSM nucleic acids from Round 1 encoding NCSM polypeptides having a preferential or similar binding to CD28 relative to CTLA-4, designated as CD28 binding proteins ("CD28BP"), as compared to the binding of WT hB7-1 to CD28 relative to CTLA-4, and/or having an ability to induce proliferation of T cells with T cell receptor co-engagement (e.g., in conjunction with stimulation of T cell receptor by, e.g., an antigen or antiCD3 Ab) are shown in SEQ ID NOS:1–4, which encode NCSM polypeptides identified herein as SEQ ID NOS:48–51. Exemplary NCSM nucleic acids from Round 1 encoding NCSM polypeptides having a preferential or similar binding to CTLA-4 relative to CD28, designated as CTLA-4 binding proteins ("CTLA-4BP"), as compared to the binding of WT hB7-1 to CTLA-4 relative to CD28, and/or having an ability to inhibit proliferation of T cells with T cell receptor co-engagement (e.g., in conjunction with stimulation of T cell receptor by, e.g., an antigen or antiCD3 Ab) are shown in SEQ ID NOS:22–26, which encode NCSM polypeptides identified herein as SEQ ID NOS:69–73.

Exemplary clones from Round 1 were further recombined in Round 2 to form recombinant polynucleotide libraries.

Similar screenings were done as in Round 1 for the polynucleotide clones produced in Round 2. Exemplary recursively recombined NCSM nucleic acids encoding NCSM polypeptides having a preferential or similar binding to CD28 relative to CTLA-4 as compared to the binding of WT hB7-1 to CD28 relative to CTLA-4 (e.g., CD28BP polypeptides), and/or having an ability to induce proliferation of T cells in conjunction with stimulation of T cell receptor in SEQ ID NOS:5–21 and SEQ ID NOS:95–142, which encode NCSM polypeptides identified herein as SEQ ID NOS:52–68, SEQ ID NOS:174–221. Additional identified recombinant CD28BP polypeptides that were identified include SEQ ID NOS:283–285 and 289–293.

Exemplary nucleic acids from Round 2 encoding NCSM polypeptides having preferential binding to CTLA-4 relative to CD28 as compared to the binding of WT hB7-1 to CTLA-4 relative to CD28 (e.g., CTLA-4BP polypeptides), and/or having an ability to inhibit proliferation of T cells in conjunction with stimulation of T cell receptor are described in SEQ ID NOS:27–45 and SEQ ID NOS:143–262, which encode NCSM polypeptides identified herein as SEQ ID NOS:74–92 and SEQ ID NOS:222–252, and 263–272. Additional recombinant CTLA-4BP polypeptides that were identified include SEQ ID NOS:286–288.

The term "preferential binding" in reference to an ability of an NCSM polypeptide of the invention to bind or specifically bind a CD28 receptor and/or CTLA-4 receptor typically refers to a preferential ability of the NCSM polypeptide to bind one or both of these two receptors (or to bind one such receptor relative to the other) as compared to the ability of a WT B7-1 (e.g., human, primate, or mammalian B7-1) to bind one or both of these two receptors (or to bind one such receptor relative to the other). A ligand's preferential binding to a receptor typically refers to a greater, enhanced, or improved binding of the ligand to the receptor as compared to the binding of a control molecule to the receptor.

The ratio of the relative binding affinity of each CD28BP polypeptide for CD28 and CTLA-4 was determined and defined as the CD28/CTLA-4 binding affinity ratio. A ratio of the relative binding affinity of WT hB7-1 for CD28 and CTLA-4 was also determined for comparison. The CD28/CTLA-4 binding affinity ratios of the CD28BP polypeptides were each found to be at least about equal to or greater than the CD28/CTLA-4 binding affinity ratio of WT hB7-1. The ratio of the relative binding affinity of each CTLA-4BP polypeptide for CD28 and CTLA-4 was also determined (i.e., CTLA-4/CD28 binding affinity ratio). A ratio of the relative binding affinity of WT hB7-1 for each of CTLA-4 and CD28 was also determined. The CTLA-4/CD28 binding affinity ratios of the CTLA-4BP polypeptides were each found to be at least about equal to or greater than the CTLA-4/CD28 binding affinity ratio of WT hB7-1.

Assays for detecting the production of specific cytokines were also performed, as described in detail below, to identify NCSM polynucleotides of the invention encoding NCSM polypeptides of the invention.

The cloned WT cow B7-1 (SEQ ID NO:280) and WT rabbit B7-1 (SEQ ID NO:281) polypeptides also worked in the binding and T cell functional assays described herein. Both cow and rabbit B7-1 polypeptides induced a T cell response in human T cells. The relative CD28/CTLA-4 binding affinity ratio of WT cow B7-1 polypeptide was found to be significantly greater than that of WT hB7-1. The relative CD28/CTLA-4 binding affinity ratio of WT rabbit B7-1 polypeptide was found to be greater than that of WT hB7-1 (data not shown).

While NCSM polynucleotides of the present invention were identified principally using the cell-based proliferation assays, receptor binding assays, and cytokine production assays described supra and infra, other assays that rely on alternative means of detection are equally suitable. For example, induction of other visual markers by receptor binding can be favorably employed. Similarly, direct binding to a receptor, e.g., by Biacore plasmon resonance, can be utilized. Other specific cytokine assays well known in the art and used for analysis of B7-1 molecules can also be utilized.

Soluble NCSM peptide constructs, including, e.g., extracellular domains of NCSM polypeptides, or fragments or subsequences thereof, alone or fused to immunoglobulin (Ig) polypeptide sequences, were also made and analyzed for receptor binding, ability to enhance or reduce an immune response, e.g., inhibit or augment T cell proliferation and/or activation, and ability to produce specific cytokine or alter or augment their levels. Nucleotide coding sequences for these soluble NCSM peptides constructs were determined. As described in detail below, such soluble NCSM polypeptides are useful in a variety of therapeutic, prophylactic, and/or diagnostic applications and methods.

The NCSM polynucleotides of the present invention that encode NCSM polypeptides are useful in a variety of applications discussed in greater detail below. For example, NCSM polynucleotides can be incorporated into expression vectors useful for gene therapy, DNA vaccination, and immunotherapy. Such vectors comprising NCSM polynucleotides encoding NCSM polypeptides are useful in clinical and medical applications in which it is desirable to provide specific proliferation/activation or anti-proliferation/inactivation of T cells that have encountered their specific antigen. Such vectors comprising NCSM polynucleotides of the invention are also useful in applications designed to break or avoid tolerance (e.g., vaccine adjuvants, treatment of malignant diseases and treatment of chronic infectious diseases), as where an enhanced immune response is desirable, or applications designed to induce tolerance (e.g., autoimmunity, severe allergy/asthma and organ transplantation), as where a decreased immune response is desirable.

CD28BP Polynucleotides

The invention provides nucleic acids that encode NCSM polypeptides and fragments thereof, wherein such polypeptides and fragments thereof bind either or both of CD28 or CTLA-4 receptor. The binding of molecules can generally be considered specific if the binding affinity is about $1\times10^2$ $M^{-1}$ to about $1\times10^7$ $M^{-1}$ (i.e., about $10^{-2}$- about $10^{-7}$ M) or greater. A "CD28 binding protein" or "CD28 binding polypeptide" ("CD28BP") refers generally to a protein or polypeptide, or fragment or subsequence thereof (such as, e.g., an ECD or trunECD), that binds to or associates with a CD28 receptor. A "CTLA-4 binding protein" or "CTLA-4 binding polypeptide" ("CTLA-4BP") refers generally to a protein or polypeptide, or fragment or subsequence thereof (such as, e.g., an ECD or trunECD), that binds to or associates with a CTLA-4 receptor. A CD28BP polynucleotide is a nucleic acid sequence that encodes a CD28BP amino acid sequence. A CTLA-4BP polynucleotide is a nucleic acid sequence that encodes a CTLA-4BP amino acid sequence.

In one aspect, the invention provides isolated or recombinant nucleic acids that each comprise a polynucleotide sequence selected from: (a) a polynucleotide sequence selected from SEQ ID NOS:1–21 and 95–142, or a complementary polynucleotide sequence thereof; (b) a polynucleotide sequence encoding a polypeptide selected from SEQ ID NOS:48–68, 174–221, 283–285, and 290–293, or a complementary polynucleotide sequence thereof; (c) a polynucleotide sequence which hybridizes under highly stringent conditions over substantially the entire length of polynucleotide sequence (a) or (b); and (d) a polynucleotide sequence comprising all or a fragment of (a), (b), or (c), wherein the fragment encodes a polypeptide having a CD28/CTLA-4 binding affinity ratio equal to or greater than the CD28/CTLA-4 binding affinity ratio of human B7-1.

In another aspect, the invention provides isolated or recombinant nucleic acids that each comprises a polynucleotide sequence encoding a polypeptide, wherein the encoded polypeptide comprises an amino acid sequence which is (a) substantially identical over at least about 100 contiguous amino acid residues of any one of SEQ ID NOS:48–68, 174–221, 283–285, and 290–293 and (b) is a non naturally-occurring sequence. In some instances, the encoded polypeptide is substantially identical over at least about 150 contiguous amino acid residues of any one of SEQ ID NOS:48–68, 174–221, 283–285, and 290–293.

In yet another aspect, the invention provides isolated or recombinant nucleic acids that each comprise a nucleotide sequence coding for a polypeptide comprising the amino acid sequence set forth in any of SEQ ID NOS:48–68, 174–221, 283–285, and 290–293, or a subsequence thereof, wherein the subsequence comprises at least one of the signal sequence, ECD, transmembrane domain, and cytoplasmic domain of the polypeptide, and wherein the amino acid sequence or subsequence is a non naturally-occurring sequence.

For some of the CTLA-4BP nucleic acids described above, the polypeptide encoded by the nucleic acid has one of more of the following properties:1) a CD28/CTLA-4 binding affinity ratio equal to or greater than the CD28/CTLA-4 binding affinity ratio of human B7-1; 2) either an equal or an enhanced binding affinity for CD28 as compared to a binding affinity of a wild type co-stimulatory molecule for CD28; 3) a decreased or a lowered binding affinity for CTLA-4 as compared to a binding affinity of a wild type co-stimulatory molecule for CTLA-4; induces T-cell proliferation or T-cell activation or both; or 4) modulates T-cell activation, but does not induce proliferation of purified T-cells activated by soluble anti-CD3 mAbs.

CTLA-4BP Polynucleotides

The invention includes isolated or recombinant nucleic acids that each comprise a polynucleotide sequence selected from: (a) a polynucleotide sequence selected from SEQ ID NOS:22–45, 143–173, or a complementary polynucleotide sequence thereof; (b) a polynucleotide sequence encoding a polypeptide selected from SEQ ID NOS:69–92, 222–247, 286–289, or a complementary polynucleotide sequence thereof; (c) a polynucleotide sequence which hybridizes under highly stringent conditions over substantially the entire length of polynucleotide sequence (a) or (b); and (d) a polynucleotide sequence comprising all or a fragment of (a), (b), or (c); wherein (c) or (d) encodes a polypeptide having a non naturally-occurring sequence comprising at least one of: Gly at position 2; Thr at position 4; Arg at position 5; Gly at position 8; Pro at position 12; Met at position 25; Cys at position 27; Pro at position 29; Leu at position 31; Arg at position 40; Leu at position 52; His at position 65; Ser at position 78; Asp at position 80; Tyr at position 87; Lys at position 120; Asp at position 122; Lys at position 129; Met at position 135; Phe at position 150; Ile at position 160; Ala at position 164; His at position 172; Phe at position 174; Leu at position 176; Asn at position 178; Asn at position 186; Glu at position 194; Gly at position 196; Thr at position 199; Ala at position 210; His at position 212; Arg at position 219; Pro at position 234; Asn at position 241; Leu at position 244; Thr at position 250; Ala at position 254; Tyr at position 265; Arg at position 266; Glu at position 273; Lys at position 275; Ser at position 276; an amino acid deletion at position 276; and Thr at position 279, wherein the position number corresponds to that of the human B7-1 amino acid sequence (SEQ ID NO:278), and wherein said polypeptide has a CTLA-4/CD28 binding affinity ratio equal to or greater than the CTLA-4/CD28 binding affinity ratio of human B7-1.

In another aspect, the invention provides isolated or recombinant nucleic acids that comprise a polynucleotide sequence selected from: (a) a polynucleotide sequence selected from SEQ ID NOS:253–262, or a complementary polynucleotide sequence thereof; (b) a polynucleotide sequence encoding a polypeptide selected from SEQ ID NOS:263–272, or a complementary polynucleotide sequence thereof; (c) a polynucleotide sequence which hybridizes under highly stringent conditions over substantially the entire length of polynucleotide sequence (a) or (b) and encodes a polypeptide having a non naturally-occurring sequence; and (d) a polynucleotide sequence comprising all or a fragment of (a), (b), or (c), wherein the fragment encodes a polypeptide having (i) a non naturally-occurring sequence and (ii) a CTLA-4/CD28 binding affinity ratio equal to or greater than that of human B7-1.

In another aspect, the invention provides isolated or recombinant nucleic acids comprising a polynucleotide sequence encoding a polypeptide, the encoded polypeptide comprising an amino acid sequence which is substantially identical over at least about 125, 150, 175, 200, 225, 250, or more contiguous amino acid residues of any one of SEQ ID NOS:69–92, 222–247, 263–272, and 286–289.

The invention also provides isolated or recombinant nucleic acids that each comprise a nucleotide sequence coding for a polypeptide comprising the amino acid sequence set forth in any of SEQ ID NOS:69–92, 222–247, 263–272, and 286–289, or a subsequence thereof, wherein the subsequence comprises at least one of: the signal sequence, extracellular domain, transmembrane domain, and cytoplasmic domain of said polypeptide, and wherein the amino acid sequence or subsequence is a non naturally-occurring sequence.

For each such CTLA-4BP nucleic acid described above, a polypeptide therefrom has a CTLA-4/CD28 binding affinity ratio equal to or greater than the CTLA-4/CD28 binding affinity ratio of human B7-1. Furthermore, the polypeptide encoded by some such CTLA-4BP nucleic acids has either a same binding affinity or an enhanced binding affinity for CD28 as compared to a binding affinity of a wild type co-stimulatory molecule for CD28. Some such encoded polypeptides have a decreased or a lowered binding affinity for CTLA-4 as compared to a binding affinity of a wild type co-stimulatory molecule for CTLA-4 (e.g., a mammalian B7-1, such as hB7-1). Some such encoded polypeptides inhibit either or both T-cell proliferation or T-cell activation. Some such encoded polypeptides modulate T-cell activation, but do not induce proliferation of purified T-cells activated by soluble anti-CD3 mAbs.

In addition, the invention provides novel isolated or recombinant nucleic acids corresponding to baboon and orangutan B7-1. Such sequences comprise a polynucleotide sequence selected from: (a) a polynucleotide sequence selected from SEQ ID NO:46, SEQ ID NO:47, or a complementary polynucleotide sequence thereof; (b) a polynucleotide sequence encoding a polypeptide selected from SEQ ID NO:93, SEQ ID NO:94, or a complementary polynucleotide sequence thereof; (c) a polynucleotide sequence encoding a subsequence of a polypeptide selected from SEQ ID NO:93, SEQ ID NO:94, or a complementary polynucleotide sequence thereof, wherein the subsequence comprises at least one of: the signal sequence, extracellular domain, transmembrane domain, and the cytoplasmic domain of said polypeptide.

Additional Aspects

Any of the CD28BP and CTLA-4BP nucleic acids described above may acid encode a fusion protein comprising at least one additional amino acid sequence. The at least one additional amino acid sequence comprises an Ig polypeptide. The polypeptide may comprise a human IgG polypeptide or Fc domain of an IgG polypeptide, and may comprise an Fc hinge, a CH2 domain, and a CH3 domain. Exemplary IgG1 polypeptides and their sequences are shown in the Examples below.

A polypeptide encoded by any of the CD28BP and CTLA-4BP nucleic acids described above may comprise at least one of a signal sequence, a precursor peptide, and an epitope tag sequence or Histidine tag.

In another aspect, the invention provides cells comprising one or more of the CD28BP or CTLA-4BP nucleic acids described above. Such cells may express one or more polypeptides encoded by the nucleic acids of the invention.

The invention also provides vectors comprising any of the CTLA-4BP or CD28BP nucleic acids described above. Such vectors may comprise a plasmid, a cosmid, a phage, a virus, or a fragment of a virus. Such vectors may comprise an expression vector, and, if desired, the CD28BP or CTLA-4BP nucleic acid is operably linked to a promoter, including those discussed herein and below.

Such a vector may be a bicistronic vector, comprising in addition to a nucleotide sequence encoding a CD28BP or CTLA-4BP, a nucleotide sequence encoding a transgene, such as an antigen, marker, or other co-stimulatory molecule. In one embodiment, the antigen is a cancer antigen, such as EpCam or another cancer antigen described below, or viral antigen. In such expression vector, the nucleic acid may be operably linked to first promoter and the polynucleotide sequence encoding the antigen may operably linked to a second promoter. Each promoter can comprise any promoter described below. In one aspect, one or both promoters in the expression vector that includes a CD28BP or CTLA-4BP polypeptide-encoding nucleotide sequence is a CMV promoter or variant thereof. The vector may further comprise a bovine growth hormone (BGH) poly adenylation sequence or SV40 polyA sequence.

Figure 21:
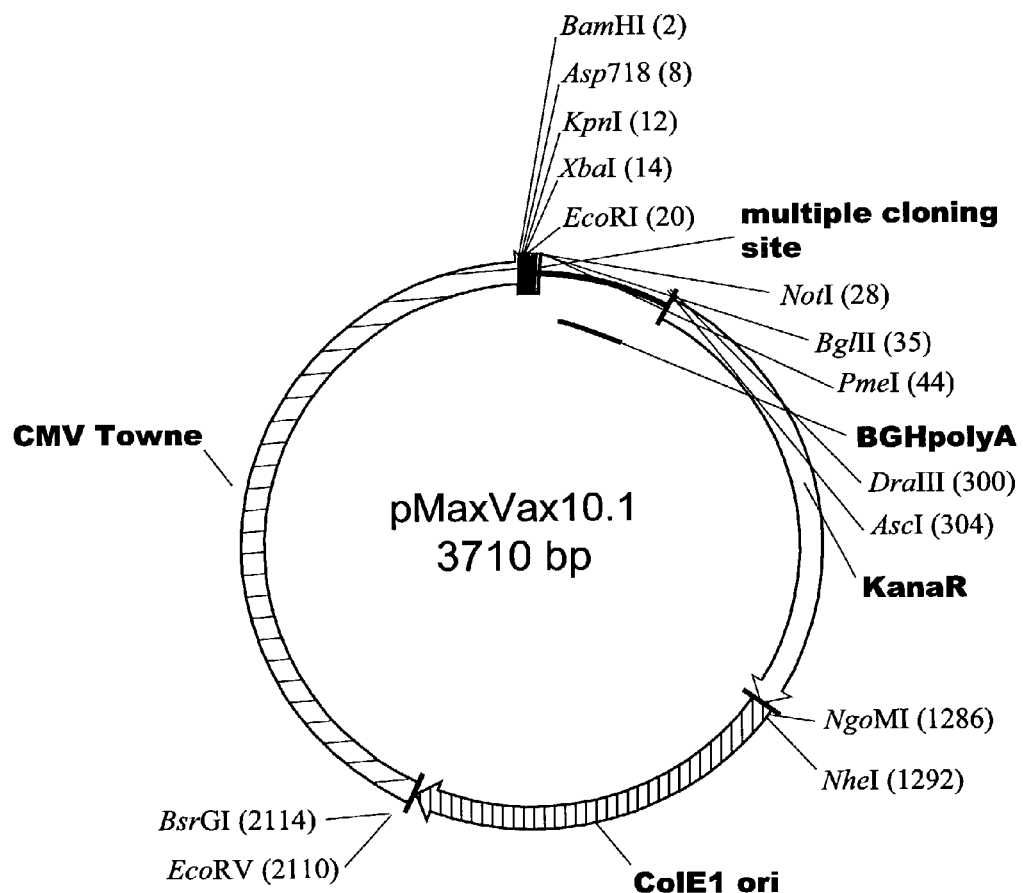
FIG. 21 illustrates a pMaxVax10.1 plasmid expression vector.
Figure 22A:
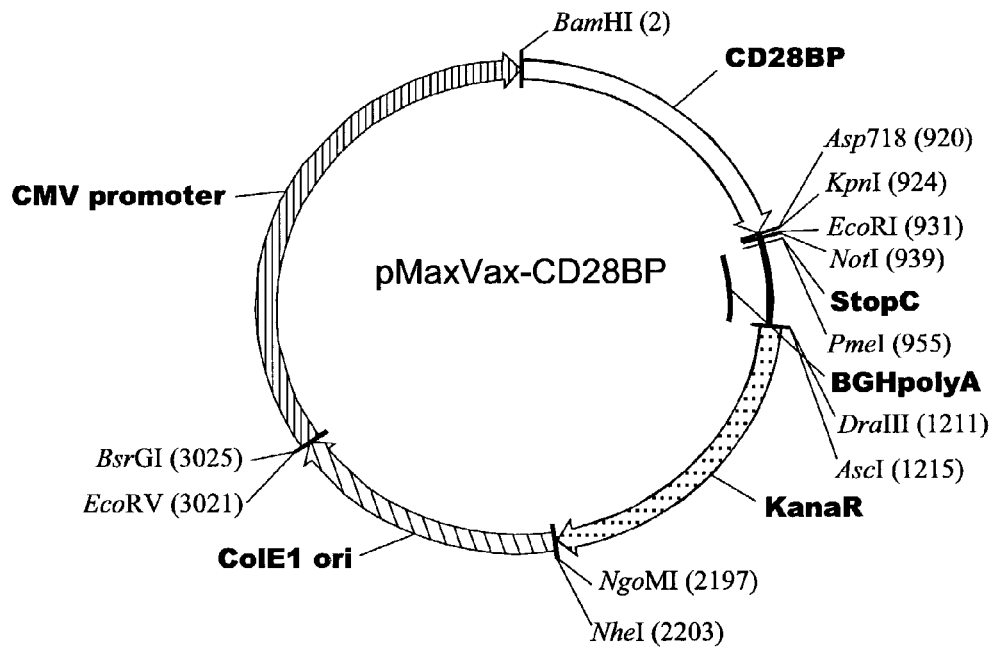
FIG. 22A illustrates a pMaxVax10.1 plasmid expression vector that comprises a nucleotide sequence encoding a CD28BP polypeptide.

A preferred "backbone" expression vector is that shown in FIG. 21; the expression vector components shown in this backbone vector may be used with any NCSM nucleic acid sequence. Other expression vector elements that can be employed and other vector types and formats are described in detail below. A preferred expression vector that includes a CD28BP or CTLA-4BP polypeptide-encoding nucleotide sequence is shown in FIG. 22A. The components of a preferred bicistronic expression vector that includes a CD28BP polypeptide-encoding nucleotide sequence, such as that encoding clone CD28BP-15, and a nucleic acid sequence encoding EpCam are shown in FIG. 23A.

The invention also provides host cells comprising any of the vectors that comprise nucleotide sequences encoding any CD28BP or CTLA-4BP described herein.

Furthermore, in another aspect, the invention provides compositions comprising an excipient or carrier and at least one of any of the CD28BP or CTLA-4BP nucleic acids, or vectors, cells, or host comprising such nucleic acids. Such composition may be pharmaceutical compositions, and the excipient or carrier may be a pharmaceutically acceptable excipient or carrier.

The invention also includes compositions comprising two or more NCSM polynucleotides of the invention or fragments thereof (e.g., as substrates for recombination). The composition can comprise a library of recombinant nucleic acids, where the library contains at least 2, at least 3, at least 5, at least 10, at least 20, at least 50, or at least 100 or more nucleic acids described above. The nucleic acids are optionally cloned into expression vectors, providing expression libraries.

The NCSM polynucleotides of the invention and fragments thereof, as well as vectors comprising such polynucleotides, may be employed for therapeutic or prophylactic uses in combination with a suitable carrier, such as a pharmaceutical carrier. Such compositions comprise a therapeutically and/or prophylactically effective amount of the compound, and a pharmaceutically acceptable carrier or excipient. Such a carrier or excipient includes, but is not limited to, saline, buffered saline, dextrose, water, glycerol, ethanol, and combinations thereof. The formulation should suit the mode of administration. Methods of administering nucleic acids, polypeptides, and proteins are well known in the art, and are further discussed below.

The invention also includes compositions produced by digesting one or more of any of the NCSM nucleic acids described above with a restriction endonuclease, an RNAse, or a DNAse (e.g., as is performed in certain of the recombination formats noted above); and compositions produced by fragmenting or shearing one or more NCSM polynucleotides of the invention by mechanical means (e.g., sonication, vortexing, and the like), which can also be used to provide substrates for recombination in the methods described herein. The invention also provides compositions produced by cleaving at least one of any of the CD28BP or CTLA-4BP nucleic acids described above. The cleaving may comprise mechanical, chemical, or enzymatic cleavage, and the enzymatic cleavage may comprise cleavage with a restriction endonuclease, an RNAse, or a DNAse.

Also included in the invention are compositions produced by a process comprising incubating one or more of the fragmented nucleic acid sets in the presence of ribonucleotide or deoxyribonucleotide triphosphates and a nucleic acid polymerase. This resulting composition forms a recombination mixture for many of the recombination formats noted above. The nucleic acid polymerase may be an RNA polymerase, a DNA polymerase, or an RNA-directed DNA polymerase (e.g., a "reverse transcriptase"); the polymerase can be, e.g., a thermostable DNA polymerase (e.g., VENT, TAQ, or the like).

Similarly, compositions comprising sets of oligonucleotides corresponding to more than one NCSM nucleic acids of the invention are useful as recombination substrates and are a feature of the invention. For convenience, these fragmented, sheared, or oligonucleotide synthesized mixtures are referred to as fragmented nucleic acid sets.

In one aspect, the invention provides an isolated or recombinant nucleic acid encoding a polypeptide that has a CTLA-4/CD28 binding affinity ratio equal to or greater than the CTLA-4/CD28 binding affinity ratio of hB7-1, produced by mutating or recombining at least one CTLA-4BP nucleic acid described above. In another aspect, the invention provides an isolated or recombinant nucleic acid encoding a polypeptide that has a CD28/CTLA-4 binding affinity ratio equal to or greater than the CD28/CTLA-4 binding affinity ratio of hB7-1, produced by mutating or recombining at least one CD28BP nucleic acid described above.

The invention also provides a chimeric or recombinant polynucleotide that encodes a polypeptide having a CD28/CTLA-4 binding affinity ratio equal to or greater than the CD28/CTLA-4 binding affinity ratio of hB7-1. In some aspects, such encoded polypeptide is a mammalian B7-1 variant. In some aspects, such polypeptide comprises an amino acid sequence comprising one or more amino acid subsequences corresponding to amino acid subsequences of wild-type cow B7-1, baboon B7-1, rabbit B7-1, and human B7-1 polypeptides. In some aspects, such polypeptide exhibits an ability to induce a T cell proliferation or activation response of T cells (e.g., stimulated by antiCD3 Abs or antigen) greater than that of cow B7-1, rabbit B7-1 or human B7-1. Chimeric or recombinant polypeptides encoded therefrom are also an aspect of the invention (see, e.g., FIG. 8B).

In addition, the invention includes a chimeric or recombinant polynucleotide that encodes a polypeptide having a CTLA-4/CD28 binding affinity ratio equal to or greater than that of hB7-1. In some aspects, such encoded polypeptide is a mammalian B7-1 variant. In some aspects, such polypeptide comprises an amino acid sequence comprising one or more amino acid subsequences corresponding to amino acid subsequences of wild-type rhesus B7-1, baboon B7-1, human B7-1, orangutan B7-1, and cow B7-1 polypeptides. In some aspects, such polypeptide exhibits an ability to suppress or inhibit a T cell proliferation or activation response (e.g., of T cells stimulated by antiCD3 Abs or antigen) relative to that induced human B7-1. Chimeric or recombinant polypeptides encoded therefrom are also an aspect of the invention (see, e.g., FIG. 8A).

Making Polynucleotides

NCSM polynucleotides, oligonucleotides, and nucleic acid fragments of the invention can be prepared by standard solid-phase methods, according to known synthetic methods. Typically, fragments of up to about 100 bases are individually synthesized, then joined (e.g., by enzymatic or chemical ligation methods, or polymerase mediated recombination methods) to form essentially any desired continuous sequence. For example, the NCSM polynucleotides and oligonucleotides of the invention can be prepared by chemical synthesis using, e.g., classical phosphoramidite method described by, e.g., Beaucage et al. (1981) *Tetrahedron Letters* 22:1859–69, or the method described by Matthes et al. (1984) *EMBO J* 3:801–05, e.g., as is typically practiced in automated synthetic methods. According to the phosphoramidite method, oligonucleotides are synthesized, e.g., in an automatic DNA synthesizer, purified, annealed, ligated and cloned into appropriate vectors.

In addition, essentially any nucleic acid can be custom ordered from any of a variety of commercial sources, such as The Midland Certified Reagent Company (mcrc@oligos.com), The Great American Gene Company (see genco website with extension of ".com"), ExpressGen Inc. (see expressgen website with the extension of ".com"), Operon Technologies Inc. (Alameda, Calif.) and many others. Similarly, peptides and antibodies can be custom ordered from any of a variety of sources, e.g., PeptidoGenic (see pkim@ccnet with the extension of ".com"), HTI Bioproducts, Inc. (see htbio website with the extension of ".com"), BMA Biomedicals Ltd. (U.K.), Bio.Synthesis, Inc., and many others.

Certain NCSM polynucleotides of the invention may also be obtained by screening cDNA libraries (e.g., libraries generated by recombining homologous nucleic acids as in typical recursive sequence recombination methods) using oligonucleotide probes that can hybridize to or PCR-amplify polynucleotides which encode the NCSM polypeptides and fragments of those polypeptides. Procedures for screening and isolating cDNA clones are well-known to those of skill in the art. Such techniques are described in, e.g., Berger and Kimmel, *Guide to Molecular Cloning Techniques, Methods in Enzymol*. Vol. 152, Acad. Press, Inc., San Diego, Calif. ("Berger"); Sambrook, supra, and *Current Protocols in Molecular Biology*, Ausubel, supra. Some NCSM polynucleotides of the invention can be obtained by altering a naturally occurring backbone, e.g., by mutagenesis, recursive sequence recombination (e.g., shuffling), or oligonucleotide recombination. In other cases, such polynucleotides can be made in silico or through oligonucleotide recombination methods as described in the references cited herein.

As described in more detail herein, the NCSM polynucleotides of the invention include polynucleotide sequences that encode NCSM polypeptide sequences and fragments thereof (including all forms of soluble NCSM polypeptides and fusion proteins), polynucleotide sequences complementary to these polynucleotide sequences and fragments thereof, polynucleotides that hybridize under at least stringent conditions to NCSM sequences defined herein, novel fragments of coding sequences and complementary sequences thereof, and variants, analogs, and homologue derivatives of all of the above. A coding sequence refers to a nucleotide sequence encodes a particular polypeptide or domain, region, or fragment of said polypeptide. A coding sequence may code for a NCSM polypeptide or fragment thereof having a functional property, such as a an ability to bind a receptor, induce or suppress T cell proliferation in conjunction with stimulation of T cell receptor (by, e.g., an antigen or antiCD3 Ab), or induce or stimulate a cytokine response as described herein. The polynucleotides of the invention can be in the form of RNA or in the form of DNA, and include mRNA, cRNA, synthetic RNA and DNA, and cDNA. The polynucleotides can be double-stranded or single-stranded, and if single-stranded, can be the coding strand or the non-coding (anti-sense, complementary) strand. The NCSM polynucleotides optionally include the coding sequence of a NCSM polypeptide (i) in isolation, (ii) in combination with one or more additional coding sequences, so as to encode, e.g., a fusion protein, a pre-protein, a prepro-protein, or the like, (iii) in combination with non-coding sequences, such as introns, control elements, such as a promoter (e.g., naturally occurring or recombinant or shuffled promoter), a terminator element, or 5' and/or 3' untranslated regions effective for expression of the coding sequence in a suitable host, and/or (iv) in a vector, cell, or host environment in which NCSM coding sequence is a heterologous gene. The NCSM polynucleotides include the respective coding sequences of components of a NCSM polypeptide, including, e.g., the coding sequence for each of the signal peptide, ECD, transmembrane domain, cytoplasmic domain, mature region, and fragments thereof, and variants, analogs, and homologue derivatives thereof. Polynucleotide sequences can also be found in combination with typical compositional formulations of nucleic acids, including in the presence of carriers, buffers, adjuvants, excipients, and the like, as are known to those of ordinary skill in the art. NCSM nucleotide fragments typically comprise at least about 500 nucleotide bases, usually at least about 600, 650, or 700 bases, and often 750 or more bases. The nucleotide fragments, variants, analogs, and homologue derivatives of NCSM polynucleotides may have hybridize under highly stringent conditions to a NCSM polynucleotide or homologue sequence described herein and/or encode amino acid sequences having at least one of the properties of receptor binding, ability to alter an immune response via, e.g., T cell activation /proliferation, and cytokine production of NCSM polypeptides described herein.

Using Polynucleotides

The NCSM polynucleotides and fragments, variants, and homologues thereof of the invention have a variety of uses in, for example, recombinant production (i.e., expression) of the NCSM polypeptides of the invention typically through expression of a plasmid expression vector comprising a sequence encoding a NCSM polypeptide or fragment thereof (e.g., ECD domain); as therapeutics; as prophylactics; as diagnostic tools; as immunogens; as adjuvants; as diagnostic probes for the presence of complementary or partially complementary nucleic acids (including for detection of natural B7-1 or related co-stimulatory molecule coding nucleic acids) as substrates for further reactions, e.g., recursive sequence recombination reactions or mutation reactions to produce new and/or improved homologues, and the like.

Expression of Polypeptides from Polynucleotides

In accordance with the present invention, NCSM polynucleotide sequences which encode novel full-length or mature NCSM polypeptides or proteins, fragments, variants or homologues thereof, related fusion polypeptides or proteins, or functional equivalents thereof, collectively referred to herein, e.g., as "NCSM" molecules, are used in recombinant DNA molecules that direct the expression of the NCSM polypeptides in appropriate host cells. Due to the inherent degeneracy of the genetic code, other nucleic acid sequences that encode substantially the same or a functionally equivalent amino acid sequence are also used to synthesize, clone and express the NCSM polypeptides.

Modified Coding Sequences

As will be understood by those of ordinary skill in the art, it can be advantageous to modify a coding sequence to enhance its expression in a particular host. The genetic code is redundant with 64 possible codons, but most organisms preferentially use a subset of these codons. The codons that are utilized most often in a species are called optimal codons, and those not utilized very often are classified as rare or low-usage codons (see, e.g., Zhang, S. P. et al. (1991) *Gene* 105:61–72). Codons can be substituted to reflect the preferred codon usage of the host, a process called "codon optimization" or "controlling for species codon bias."

Optimized coding sequence containing codons preferred by a particular prokaryotic or eukaryotic host (see, e.g., Murray, E. et al. (1989) *Nuc Acids Res* 17:477–508) can be prepared, for example, to increase the rate of translation or to produce recombinant RNA transcripts having desirable properties, such as a longer half-life, as compared with transcripts produced from a non-optimized sequence. Translation stop codons can also be modified to reflect host preference. For example, preferred stop codons for *S. cerevisiae* and mammals are UAA and UGA respectively. The preferred stop codon for monocotyledonous plants is UGA, whereas insects and *E. coli* prefer to use UAA as the stop codon (Dalphin, M. E. et al. (1996) *Nuc Acids Res* 24:216–218).

The polynucleotide sequences of the present invention can be engineered in order to alter an NCSM coding sequence of the invention for a variety of reasons, including but not limited to, alterations which modify the cloning, processing and/or expression of the gene product. For example, alterations may be introduced using techniques which are well known in the art, e.g., site-directed mutagenesis, to insert new restriction sites, to alter glycosylation patterns, to change codon preference, to introduce splice sites, etc. Further details regarding silent and conservative substitutions are provided below.

Vectors, Promoters, and Expression Systems

The present invention also includes recombinant constructs comprising one or more of the nucleic acid sequences as broadly described above. The constructs comprise a vector, such as, a plasmid, a cosmid, a phage, a virus, a bacterial artificial chromosome (BAC), a yeast artificial chromosome (YAC), and the like, into which a nucleic acid sequence of the invention (e.g., one which encodes a NCSM polypeptide or fragment thereof) has been inserted, in a forward or reverse orientation. In a preferred aspect of this embodiment, the construct further comprises regulatory sequences, including, for example, a promoter, operably linked to the nucleic acid sequence. Large numbers of suitable vectors and promoters are known to those of skill in the art, and are commercially available.

General texts that describe molecular biological techniques useful herein, including the use of vectors, promoters and many other relevant topics, include Berger, supra; Sambrook (1989), supra, and Ausubel, supra. Examples of techniques sufficient to direct persons of skill through in vitro amplification methods, including the polymerase chain reaction (PCR) the ligase chain reaction (LCR), Q∃-replicase amplification and other RNA polymerase mediated techniques (e.g., NASBA), e.g., for the production of the homologous nucleic acids of the invention are found in Berger, Sambrook, and Ausubel, all supra, as well as Mullis et al. (1987) U.S. Pat. No. 4,683,202; *PCR Protocols: A Guide to Methods and Applications* (Innis et al., eds.) Academic Press Inc. San Diego, Calif. (1990) ("Innis"); Arnheim & Levinson (Oct. 1, 1990) *C&EN* 36–47; *The Journal Of NIH Research* (1991) 3:81–94; (Kwoh et al. (1989) *Proc Natl Acad Sci USA* 86:1173–1177; Guatelli et al. (1990) *Proc Natl Acad Sci USA* 87:1874–1878; Lomeli et al. (1989) *J Clin Chem* 35:1826–1831; Landegren et al. (1988) *Science* 241:1077–1080; Van Brunt (1990) *Biotechnology* 8:291–294; Wu and Wallace (1989) *Gene* 4:560–569; Barringer et al. (1990) *Gene* 89:117–122, and Sooknanan and Malek (1995) *Biotechnology* 13:563–564. Improved methods of cloning in vitro amplified nucleic acids are described in Wallace et al., U.S. Pat. No. 5,426,039. Improved methods of amplifying large nucleic acids by PCR are summarized in Cheng et al. (1994) *Nature* 369:684–685 and the references therein, in which PCR amplicons of up to 40 kilobases (kb) are generated. One of skill will appreciate that essentially any RNA can be converted into a double stranded DNA suitable for restriction digestion, PCR expansion and sequencing using reverse transcriptase and a polymerase. See Ausubel, Sambrook and Berger, all supra.

The present invention also provides host cells that are transduced with vectors of the invention, and the production of polypeptides of the invention by recombinant techniques. Host cells are genetically engineered (e.g., transduced, transformed or transfected) with the vectors of this invention, which may be, for example, a cloning vector or an expression vector. The vector may be, for example, in the form of a plasmid, a viral particle, a phage, etc. The engineered host cells can be cultured in conventional nutrient media modified as appropriate for activating promoters, selecting transformants, or amplifying the NCSM gene. The culture conditions, such as temperature, pH, and the like, are those previously used with the host cell selected for expression, and will be apparent to those skilled in the art and in the references cited herein, including, e.g., Freshney (1994) *Culture of Animal Cells, a Manual of Basic Technique*, third edition, Wiley-Liss, New York and the references cited therein.

The NCSM polypeptides of the invention can also be produced in non-animal cells such as plants, yeast, fungi, bacteria and the like. In addition to Sambrook, Berger and Ausubel, details regarding cell culture are found in, e.g., Payne et al. (1992) *Plant Cell and Tissue Culture in Liquid Systems* John Wiley & Sons, Inc. New York, N.Y.; Gamborg and Phillips (eds.) (1995) *Plant Cell, Tissue and Organ Culture*; Fundamental Methods Springer Lab Manual, Springer-Verlag (Berlin Heidelberg N.Y.); Atlas & Parks (eds.) *The Handbook of Microbiological Media* (1993) CRC Press, Boca Raton, Fla.

The polynucleotides of the present invention and fragments and variants thereof, which encode the NCSM polypeptide molecules, may be included in any one of a variety of expression vectors for expressing a polypeptide. Such vectors include chromosomal, nonchromosomal and synthetic DNA sequences, e.g., derivatives of SV40, bacterial plasmids, phage DNA, baculovirus, yeast plasmids, vectors derived from combinations of plasmids and phage DNA, viral DNA such as vaccinia, adenovirus, fowl pox virus, pseudorabies, adeno-associated virus, retroviruses and many others. Any vector that transduces genetic material into a cell, and, if replication is desired, which is replicable and viable in the relevant host can be used.

The nucleic acid sequence in the expression vector is operatively linked to an appropriate transcription control sequence (promoter) to direct mRNA synthesis. Examples of such promoters include: LTR or SV40 promoter, *E. coli* lac or trp promoter, phage lambda $P_L$ promoter, CMV promoter, and other promoters known to control expression of genes in prokaryotic or eukaryotic cells or their viruses. The expression vector also contains a ribosome binding site for translation initiation, and a transcription terminator. The vector optionally includes appropriate sequences for amplifying expression, e.g., an enhancer. In addition, the expression vectors optionally comprise one or more selectable marker genes to provide a phenotypic trait for selection of transformed host cells, such as dihydrofolate reductase or neomycin resistance for eukaryotic cell culture, or such as tetracycline or ampicillin resistance in *E. coli*.

The vector containing the appropriate DNA sequence encoding a NCSM polypeptide, as well as an appropriate promoter or control sequence, may be employed to transform an appropriate host to permit the host to express the protein. Examples of appropriate expression hosts include: bacterial cells, such as *E. coli*, Streptomyces, and *Salmonella typhimurium*; fungal cells, such as *Saccharomyces cerevisiae, Pichia pastoris*, and *Neurospora crassa*; insect cells such as Drosophila and *Spodoptera frugiperda*; mammalian cells such as CHO, COS, BHK, HEK 293 or Bowes melanoma; plant cells, etc. It is understood that not all cells or cell lines need to be capable of producing fully functional NCSM polypeptides or fragments thereof; for example, antigenic fragments of NCSM polypeptide may be produced in a bacterial or other expression system. The invention is not limited by the host cells employed.

In bacterial systems, a number of expression vectors may be selected depending upon the use intended for the NCSM polypeptide or fragment thereof. For example, when large quantities of a NCSM polypeptide or fragments thereof are needed for the induction of antibodies, vectors which direct high level expression of fusion proteins that are readily purified may be desirable. Such vectors include, but are not limited to, multifunctional *E. coli* cloning and expression vectors such as BLUESCRIPT (Stratagene), in which NCSM nucleotide coding sequence may be ligated into the vector in-frame with sequences for the amino-terminal Met and the subsequent 7 residues of beta-galactosidase so that a hybrid protein is produced; pIN vectors (Van Heeke & Schuster (1989) *J Biol Chem* 264:5503–5509); pET vectors (Novagen, Madison Wis.); and the like.

Similarly, in the yeast *Saccharomyces cerevisiae* a number of vectors containing constitutive or inducible promoters such as alpha factor, alcohol oxidase and PGH may be used for production of the NCSM polypeptides of the invention. For reviews, see Ausubel, supra, Berger, supra, and Grant et al. (1987) *Methods in Enzymology* 153:516–544.

In mammalian host cells, a number of expression systems, such as viral-based systems, may be utilized. In cases where an adenovirus is used as an expression vector, a coding sequence is optionally ligated into an adenovirus transcription/translation complex consisting of the late promoter and tripartite leader sequence. Insertion in a nonessential E1 or E3 region of the viral genome results in a viable virus capable of expressing NCSM molecule in infected host cells (Logan and Shenk (1984) *Proc Natl Acad Sci USA* 81:3655–3659). In addition, transcription enhancers, such as the rous sarcoma virus (RSV) enhancer, are used to increase expression in mammalian host cells. Host cells, media, expression systems, and methods of production include those known for cloning and expression of various mammalian B7-1s (e.g., hB7-1 and mouse B7-1).

Promoters for use with NCSM polynucleotide sequences of the present invention include recombinant, mutated, or recursively recombined (e.g., shuffled) promoters, including optimized recombinant CMV promoters, as described in copending, commonly assigned U.S. patent application Ser. No. 09/886,942, entitled "Novel Chimeric Promoters," filed Jun. 21, 2001 as LJAQ, incorporated herein by reference in its entirety for all purposes. Such promoters can be employed in expression vectors comprising nucleotide sequences encoding, e.g., NCSM polypeptides, soluble NSCM-ECD polypeptides, or NCSM-ECD-Ig fusion proteins, or WT hB7-1s, or fragments of any of these.

In some embodiments, a recombinant or shuffled promoter having an optimized expression for a particular use with NCSM molecules is utilized. For example, in some therapeutic and/or prophylactic methods or applications, where a lower level expression of a CD28BP or CTLA-4BP is desired (than is typically obtained with a CMV promoter, such as a WT human CMV promoter), at least one recombinant or chimeric CMV promoter nucleotide sequence that is optimized to provide for reduced or suppressed expression levels of the NCSM and/or one or more associated antigens is used. Such promoter(s) is operably linked in an expression vector to either or both the NCSM polynucleotide and/or one or more associated antigens (e.g., cancer antigen, such as EpCam/KSA). In other embodiments, one or more recombinant or chimeric CMV promoters optimized for the particular application can be used, where differential expression between a NCSM polypeptide and at least one associated antigen in one or more vectors is desired (e.g., where it is desirable to express varying amounts of various NCSM polypeptide molecules or co-stimulatory molecules, since their respective concentrations influence or affect one another, and/or where it is desirable to express a comparably higher level of at least one antigen for effective treatment). For example, in some applications, a low expression level of a NCSM polypeptide and a relatively higher expression level of antigen is desired, since it may be particularly useful for successful therapeutic or prophylactic treatment of a particular condition or disease.

Additional Expression Elements

Specific initiation signals can aid in efficient translation of a NCSM polynucleotide coding sequence and/or fragments thereof. These signals can include, e.g., the ATG initiation codon and adjacent sequences. In cases where a NCSM coding sequence, its initiation codon and upstream sequences are inserted into the appropriate expression vector, no additional translational control signals may be needed. However, in cases where only coding sequence (e.g., a mature protein coding sequence), or a portion thereof, is inserted, exogenous nucleic acid transcriptional control signals including the ATG initiation codon must be provided. Furthermore, the initiation codon must be in the correct reading frame to ensure transcription of the entire insert. Exogenous transcriptional elements and initiation codons can be of various origins, both natural and synthetic. The efficiency of expression can enhanced by the inclusion of enhancers appropriate to the cell system in use (see, e.g., Scharf D. et al. (1994) *Results Probl Cell Differ* 20:125–62; and Bittner et al. (1987) *Methods in Enzymol* 153:516–544).

Secretion/Localization Sequences

Polynucleotides of the invention encoding NCSM polypeptides and fragments thereof can also be fused, for example, in-frame to nucleic acid encoding a secretion/localization sequence, to target polypeptide expression to a desired cellular compartment, membrane, or organelle, or to direct polypeptide secretion to the periplasmic space or into the cell culture media. Such sequences are known to those of skill, and include secretion leader or signal peptides, organelle targeting sequences (e.g., nuclear localization sequences, ER retention signals, mitochondrial transit sequences, chloroplast transit sequences), membrane localization/anchor sequences (e.g., stop transfer sequences, GPI anchor sequences), and the like.

Expression Hosts

In a further embodiment, the present invention relates to host cells containing any of the above-described nucleic acids, vectors, or other constructs of the invention. The host cell can be a eukaryotic cell, such as a mammalian cell, a yeast cell, or a plant cell, or the host cell can be a prokaryotic cell, such as a bacterial cell. Introduction of the construct into the host cell can be effected by calcium phosphate transfection, DEAE-Dextran mediated transfection, electroporation, gene or vaccine gun, injection, or other common techniques (see, e.g., Davis, L., Dibner, M., and Battey, I. (1986) *Basic Methods in Molecular Biology*) for in vivo, ex vivo or in vitro methods.

A host cell strain is optionally chosen for its ability to modulate the expression of the inserted sequences or to process the expressed protein in the desired fashion. Such modifications of the protein include, but are not limited to, acetylation, carboxylation, glycosylation, phosphorylation, lipidation and acylation. Post-translational processing which cleaves a "pre" or a "prepro" form of the protein may also be important for correct insertion, folding and/or function. Different host cells such as *E. coli, Bacillus* sp., yeast or mammalian cells such as CHO, HeLa, BHK, MDCK, HEK 293, W138, etc. have specific cellular machinery and characteristic mechanisms for such post-translational activities and may be chosen to ensure the correct modification and processing of the introduced foreign protein.

For long-term, high-yield production of recombinant proteins, stable expression can be used. For example, cell lines which stably express a polypeptide of the invention are transduced using expression vectors which contain viral origins of replication or endogenous expression elements and a selectable marker gene. Following the introduction of the vector, cells may be allowed to grow for 1–2 days in an enriched media before they are switched to selective media. The purpose of the selectable marker is to confer resistance to selection, and its presence allows growth and recovery of cells which successfully express the introduced sequences. For example, resistant clumps of stably transformed cells can be proliferated using tissue culture techniques appropriate to the cell type.

Host cells transformed with a nucleotide sequence encoding a NCSM polypeptide or fragments thereof of the invention are optionally cultured under conditions suitable for the expression and recovery of the encoded protein from cell culture. The protein or fragment thereof produced by a recombinant cell may be secreted, membrane-bound, or contained intracellularly, depending on the sequence and/or the vector used. As will be understood by those of skill in the art, expression vectors containing polynucleotides encoding mature NCSM polypeptides of the invention can be designed with signal sequences which direct secretion of the mature polypeptides through a prokaryotic or eukaryotic cell membrane.

The present invention also includes at least one NCSM polynucleotide consensus sequence derived from a comparison of two or more NCSM polynucleotide sequences described herein (including, e.g., a polynucleotide encoding a CD28BP or CTLA-4BP of the invention or fragment (e.g., ECD or trunECD) thereof). The present invention also includes at least one NCSM polynucleotide consensus sequence derived from a comparison of two or more NCSM polynucleotide sequences described herein. A NCSM polynucleotide consensus sequence as used herein means a nonnaturally-occurring or recombinant NCSM polynucleotide sequence that predominantly includes those nucleic acid residues that are common to all recombinant NCSM polynucleotides of the present invention described herein and that includes, at one or more of those positions wherein there is no nucleic acid residue common to all subtypes, a nucleic acid residue that predominantly occurs at that position and in no event includes any nucleic acid residue which is not extant in that position in at least one recombinant NCSM polynucleotide of the invention.

Additional Sequences

The NCSM polypeptide-encoding polynucleotides of the present invention optionally comprise a coding sequence or fragment thereof fused in-frame to a marker sequence which, e.g., facilitates purification of the encoded polypeptide. Such purification facilitating domains include, but are not limited to, metal chelating peptides such as histidine-tryptophan modules that allow purification on immobilized metals, a sequence which binds glutathione (e.g., GST), a hemagglutinin (HA) tag (corresponding to an epitope derived from the influenza hemagglutinin protein; Wilson, I. et al. (1984) *Cell* 37:767), maltose binding protein sequences, the FLAG epitope utilized in the FLAGS extension/affinity purification system (Immunex Corp, Seattle, Wash.), and the like. The inclusion of a protease-cleavable polypeptide linker sequence between the purification domain and the NCSM sequence is useful to facilitate purification.

For example, one expression vector possible to use in the compositions and methods described herein provides for expression of a fusion protein comprising a polypeptide of the invention fused to a polyhistidine region separated by an enterokinase cleavage site. The histidine residues facilitate purification on IMIAC (immobilized metal ion affinity chromatography, as described in Porath et al. (1992) *Protein Expression and Purification* 3:263–281) while the enterokinase cleavage site provides a method for separating the NCSM polypeptide from the fusion protein. pGEX vectors (Promega; Madison, Wis.) are optionally used to express foreign polypeptides as fusion proteins with glutathione S-transferase (GST). In general, such fusion proteins are soluble and can easily be purified from lysed cells by adsorption to ligand-agarose beads (e.g., glutathione-agarose in the case of GST-fusions) followed by elution in the presence of free ligand.

An additional construction in the compositions and methods described herein provides for soluble proteins, and their encoding nucleic acids, comprising NCSM polypeptides (or one or more fragments thereof), e.g., as described herein fused to an Ig molecule, e.g., human IgG Fc ("fragment crystallizable," or fragment complement binding) hinge, CH2 domain and CH3 domain (and nucleotide sequences encoding them). Fc is the portion of the antibody responsible for binding to antibody receptors on cells and the C1q component of complement. Also included are soluble forms of the NCSM polypeptides that comprise secreted forms of the NSCM polypeptides, as produced by chemical synthesis or, e.g., by introducing a plasmid encoding a secreted form of the NCSM polypeptide into a eukaryotic cell. These expressed or secreted soluble NCSM polypeptides or fragments thereof, as well as the soluble NCSM fusion proteins (e.g., NCSM-ECD-Ig fusion proteins or NCSM-truncated-ECD-Ig fusion proteins) or fragments thereof and their encoding nucleic acids are optionally useful as prophylactic and/or therapeutic drugs or as diagnostic tools (see also, e.g., Challita-Eid, P. et al. (1998) *J Immunol* 160:3419–3426; Sturmhoefel, K. et al. (1999) *Cancer Res* 59:4964–4972).

Polypeptide Production and Recovery

Following transduction of a suitable host strain and growth of the host strain to an appropriate cell density, the selected promoter is induced by appropriate means (e.g., temperature shift or chemical induction) and cells are cultured for an additional period. Cells are typically harvested by centrifugation, disrupted by physical or chemical means, and the resulting crude extract retained for further purification. Eukaryotic or microbial cells employed in expression of the NCSM proteins can be disrupted by any convenient method, including freeze-thaw cycling, sonication, mechanical disruption, or use of cell lysing agents, or other methods, which are well know to those skilled in the art.

As noted, many references are available for the culture and production of many cells, including cells of bacterial, plant, animal (especially mammalian) and archebacterial origin. See, e.g., Sambrook, Ausubel, and Berger (all supra), as well as Freshney (1994) *Culture of Animal Cells, a Manual of Basic Technique*, third edition, Wiley-Liss, New York and the references cited therein; Doyle and Griffiths (1997) *Mammalian Cell Culture: Essential Techniques* John Wiley and Sons, NY; Humason (1979) *Animal Tissue Techniques*, fourth edition W. H. Freeman and Company; and Ricciardelli et al. (1989) *In vitro Cell Dev Biol* 25:1016–1024. For plant cell culture and regeneration see, e.g., Payne et al. (1992) *Plant Cell and Tissue Culture in Liquid Systems* John Wiley & Sons, Inc. New York, N.Y.; Gamborg and Phillips (eds.) (1995) *Plant Cell, Tissue and Organ Culture*; Fundamental Methods Springer Lab Manual, Springer-Verlag (Berlin Heidelberg New York) and *Plant Molecular Biology* (1993) R. R. D. Croy (ed.) Bios Scientific Publishers, Oxford, U.K. ISBN 0 12 198370 6. Cell culture media in general are set forth in Atlas and Parks (eds.) *The Handbook of Microbiological Media* (1993) CRC Press, Boca Raton, Fla. Additional information for cell culture is found in available commercial literature such as the *Life Science Research Cell Culture Catalogue* (1998) from Sigma-Aldrich, Inc (St Louis, Mo.) ("Sigma-LSRCCC") and, e.g., the *Plant Culture Catalogue* and supplement (1997) also from Sigma-Aldrich, Inc (St Louis, Mo.) ("Sigma-PCCS").

Polypeptides of the invention can be recovered and purified from recombinant cell cultures by any of a number of methods well known in the art, including ammonium sulfate or ethanol precipitation, acid extraction, anion or cation exchange chromatography, phosphocellulose chromatography, hydrophobic interaction chromatography, affinity chromatography (e.g., using any of the tagging systems noted herein), hydroxylapatite chromatography, and lectin chromatography. Protein refolding steps can be used, as desired, in completing configuration of the mature NCSM protein or fragments thereof. Finally, high performance liquid chromatography (HPLC) can be employed in the final purification steps. In addition to the references noted, supra, a variety of purification methods are well known in the art, including, e.g., those set forth in Sandana (1997) *Bioseparation of Proteins*, Academic Press, Inc.; Bollag et al. (1996) *Protein Methods, 2$^{nd}$ Edition* Wiley-Liss, NY; Walker (1996) *The Protein Protocols Handbook* Humana Press, NJ; Harris and Angal (1990) *Protein Purification Applications: A Practical Approach* IRL Press at Oxford, Oxford, England; Harris and Angal *Protein Purification Methods: A Practical Approach* IRL Press at Oxford, Oxford, England; Scopes (1993) *Protein Purification: Principles and Practice 3$^{rd}$ Edition* Springer Verlag, NY; Janson and Ryden (1998) *Protein Purification: Principles, High Resolution Methods and Applications, Second Edition* Wiley-VCH, NY; and Walker (1998) *Protein Protocols on CD-ROM* Humana Press, NJ.

In vitro Expression Systems

Cell-free transcription/translation systems can also be employed to produce NCSM polypeptides or fragments thereof using DNAs or RNAs of the present invention or fragments thereof. Several such systems are commercially available. A general guide to in vitro transcription and translation protocols is found in Tymms (1995) *In vitro Transcription and Translation Protocols: Methods in Molecular Biology* Volume 37, Garland Publishing, NY.

Modified Amino Acids

Polypeptides of the invention may contain one or more modified amino acid. The presence of modified amino acids may be advantageous in, for example, (a) increasing polypeptide serum half-life, (b) reducing polypeptide antigenicity, or (c) increasing polypeptide storage stability. Amino acid(s) are modified, for example, co-translationally or post-translationally during recombinant production (e.g., N-linked glycosylation at N-X-S/T motifs during expression in mammalian cells) or modified by synthetic means.

Non-limiting examples of a modified amino acid include a glycosylated amino acid, a sulfated amino acid, a prenlyated (e.g., farnesylated, geranylgeranylated) amino acid, an acetylated amino acid, an acylated amino acid, a PEGylated amino acid, a biotinylated amino acid, a carboxylated amino acid, a phosphorylated amino acid, and the like. References adequate to guide one of skill in the modification of amino acids are replete throughout the literature. Example protocols are found in Walker (1998) *Protein Protocols on CD-ROM* Humana Press, Towata, N.J.

In Vivo Uses and Applications

Polynucleotides or fragments thereof that encode a NCSM polypeptide of the invention, or complements of the polynucleotides (e.g., antisense or ribozyme molecules), are optionally administered to a cell to accomplish a therapeutically useful process or to express a therapeutically useful product. These in vivo applications, including gene therapy, include a multitude of techniques by which gene expression may be altered in cells. Such methods include, for instance, the introduction of genes for expression of, e.g., therapeutically and/or prophylactically useful polypeptides, such as the NCSM polypeptides of the present invention or fragments thereof.

In Vivo Polypeptide Expression

Polynucleotides encoding NCSM polypeptides of the invention and fragments thereof are particularly useful for in vivo therapeutic applications, using techniques well known to those skilled in the art. For example, cultured cells are engineered ex vivo with at least one NCSM polynucleotide (DNA or RNA) and/or other polynucleotide sequences encoding, e.g., at least one of an antigen, cytokine, other co-stimulatory molecule, adjuvant, etc., and the like, with the engineered cells then being returned to the patient. Cells may also be engineered in vivo for expression of one or more polypeptides in vivo. including NCSM polypeptides and/or antigenic peptides.

A number of viral vectors suitable for organismal in vivo transduction and expression are known. Such vectors include retroviral vectors (see, e.g., Miller, *Curr Top Microbiol Immunol* (1992) 158:1–24; Salmons and Gunzburg (1993) *Human Gene Therapy* 4:129–141; Miller et al. (1994) *Methods in Enzymology* 217:581–599) and adeno-associated vectors (reviewed in Carter (1992) *Curr Opinion Biotech* 3:533–539; Muzcyzka (1992) *Curr Top Microbiol Immunol.* 158:97–129). Other viral vectors that are used include adenoviral vectors, herpes viral vectors and Sindbis viral vectors, as generally described in, e.g., Jolly (1994) *Cancer Gene Therapy* 1:51–64; Latchman (1994) *Molec Biotechnol* 2:179–195; and Johanning et al. (1995) *Nucl Acids Res* 23:1495–1501.

In one aspect, a pox virus vector can be used. The pox viral vector is transfected with a polynucleotide sequence encoding of the NCSM polypeptides (or fragments thereof) of the invention, such as a CD28BP polypeptide, and is useful in prophylactic, therapeutic and diagnostic applications where enhancement of an immune response, such as increased or improved T cell proliferation or activation (or inhibition of an immune response, such as inhibition of T cell proliferation, if, e.g., a polynucleotide encoding a CTAL4-BP polypeptide is used) is desired. See viral vectors discussed in, e.g., Berencsi et al., *J Infect Dis* (2001)183(8): 1171–9; Rosenwirth et al., *Vaccine* Feb. 8;19 2001 (13–14): 1661–70; Kittlesen et al., *J Immunol* (2000) 164(8):4204–11; Brown et al. *Gene Ther* 2000 7(19):1680–9; Kanesa-thasan et al., *Vaccine* (2000) 19(4–5): 483–91; Sten (2000) *Drug* 60(2):249–71. Compositions comprising such vectors and an acceptable excipient are also a feature of the invention.

Gene therapy and genetic vaccines provide methods for combating chronic infectious diseases (e.g., HIV infection, viral hepatitis), as well as non-infectious diseases including cancer and some forms of congenital defects such as enzyme deficiencies, and such methods can be employed with NCSM polynucleotides of the invention, including, e.g., vectors and cells comprising such polynucleotides. Several approaches for introducing nucleic acids and vectors into cells in vivo, ex vivo and in vitro have been used and can be employed with NCSM polynucleotides encoding NCSM polypeptides and fragments thereof (including, e.g., ECD domains and fusion proteins), and vectors comprising NCSM sequences. These approaches include liposome based gene delivery (Debs and Zhu (1993) WO 93/24640 and U.S. Pat. No. 5,641,662; Mannino and Gould-Fogerite (1988) *BioTechniques* 6(7):682–691; Rose, U.S. Pat. No. 5,279,833; Brigham (1991) WO 91/06309; and Felgner et al. (1987) *Proc Natl Acad Sci USA* 84:7413–7414; Brigham et al. (1989) *Am J Med Sci* 298:278–281; Nabel et al. (1990) *Science* 249:1285–1288; Hazinski et al. (1991) *Am J Resp Cell Molec Biol* 4:206–209; and Wang and Huang (1987) *Proc Natl Acad Sci USA* 84:7851–7855); adenoviral vector mediated gene delivery, e.g., to treat cancer (see, e.g., Chen et al. (1994) *Proc Natl Acad Sci USA* 91:3054–3057; Tong et al. (1996) *Gynecol Oncol* 61:175–179; Clayman et al. (1995) *Cancer Res.* 5:1–6; O'Malley et al. (1995) *Cancer Res* 55:1080–1085; Hwang et al. (1995) *Am J Respir Cell Mol Biol* 13:7–16; Haddada et al. (1995) *Curr Top Microbiol Immunol.* 1995 (Pt. 3):297–306; Addison et al. (1995) *Proc Natl Acad Sci USA* 92:8522–8526; Colak et al. (1995) *Brain Res* 691:76–82; Crystal (1995) *Science* 270:404–410; Elshami et al. (1996) *Human Gene Ther* 7:141–148; Vincent et al. (1996) *J Neurosurg* 85:648–654), and many others. Replication-defective retroviral vectors harboring therapeutic polynucleotide sequence as part of the retroviral genome have also been used, particularly with regard to simple MuLV vectors. See, e.g., Miller et al. (1990) *Mol Cell Biol* 10:4239 (1990); Kolberg (1992) *J NIH Res* 4:43, and Cornetta et al. (1991) *Hum Gene Ther* 2:215). Nucleic acid transport coupled to ligand-specific, cation-based transport systems (Wu and Wu (1988) *J Biol Chem,* 263:14621–14624) has also been used. Naked DNA expression vectors have also been described (Nabel et al. (1990), supra); Wolff et al. (1990) *Science,* 247:1465–1468). In general, these approaches can be adapted to the invention by incorporating nucleic acids encoding the NCSM polypeptides or fragments thereof herein into the appropriate vectors.

General texts which describe gene therapy protocols, which can be adapted to the present invention by introducing the nucleic acids of the invention into patients, include, e.g., Robbins (1996) *Gene Therapy Protocols,* Humana Press, NJ, and Joyner (1993) *Gene Targeting: A Practical Approach,* IRL Press, Oxford, England.

Antisense Technology

In addition to expression of the NCSM nucleic acids of the invention as gene replacement nucleic acids, the nucleic acids are also useful for sense and anti-sense suppression of expression, e.g., to down-regulate expression of a nucleic acid of the invention, once, or when, expression of the nucleic acid is no-longer desired in the cell. Similarly, the nucleic acids of the invention, or subsequences or anti-sense sequences thereof, can also be used to block expression of naturally occurring homologous nucleic acids. A variety of sense and anti-sense technologies are known in the art, e.g., as set forth in Lichtenstein and Nellen (1997) *Antisense*

Technology: A Practical Approach IRL Press at Oxford University, Oxford, England, and in Agrawal (1996) Antisense Therapeutics Humana Press, NJ, and the references cited therein.

Use as Probes

Also contemplated are uses of polynucleotides, also referred to herein as oligonucleotides, typically having at least 12 bases, preferably at least 15, more preferably at least 20, at least 30, or at least 50 or more bases, which hybridize under highly stringent conditions to a NCSM polynucleotide, variant or homologue sequence described herein or fragments thereof. The polynucleotides may be used as probes, primers, sense and antisense agents, and the like, according to methods as noted supra.

Sequence Variations

Silent Variations

Because of the degeneracy of the genetic code, a large number of functionally identical nucleic acids encode any given polypeptide. For instance, inspection of the codon table (Table 1) shows that codons AGA, AGG, CGA, CGC, CGG, and CGU all encode the amino acid arginine. Thus, at every position in a nucleic acid sequence where an arginine is specified by a codon, the codon can be altered to any of the corresponding codons described above without altering the encoded polypeptide. Such nucleic acid variations are "silent variations" are one species of "conservatively modified variations." It is understood that U in an RNA sequence corresponds to T in a DNA sequence.

TABLE 1

Codon Table

| Amino acids | | | Codon | |
|---|---|---|---|---|
| Alanine | Ala | A | GCA | GCC GCG GCU |
| Cysteine | Cys | C | UGC | UGU |
| Aspartic acid | Asp | D | GAC | GAU |
| Glutamic acid | Glu | E | GAA | GAG |
| Phenylalanine | Phe | F | UUC | UUU |
| Glycine | Gly | G | GGA | GGC GGG GGU |
| Histidine | His | H | CAC | CAU |
| Isoleucine | Ile | I | AUA | AUC AUU |
| Lysine | Lys | K | AAA | AAG |
| Leucine | Leu | L | UUA | UUG CUA CUC CUG CUU |
| Methionine | Met | M | AUG | |
| Asparagine | Asn | N | AAC | AAU |
| Proline | Pro | P | CCA | CCC CCG CCU |
| Glutamine | Gln | Q | CAA | CAG |
| Arginine | Arg | R | AGA | AGG CGA CGC CGG CGU |
| Serine | Ser | S | AGC | AGU UCA UCC UCG UCU |
| Threonine | Thr | T | ACA | ACC ACG ACU |
| Valine | Val | V | GUA | GUC GUG GUU |
| Tryptophan | Trp | W | UGG | |
| Tyrosine | Tyr | Y | UAC | UAU |

It will thus be appreciated by those skilled in the art that due to the degeneracy of the genetic code, a multitude of nucleic acids sequences encoding NCSM polypeptides of the invention may be produced, some of which may bear minimal sequence homology to the nucleic acid sequences explicitly disclosed herein. Using, as an example, the nucleic acid sequence corresponding to nucleotides 1–15 of SEQ ID NO:1, ATG GGT CAC ACA ATG, a silent variation of this sequence includes ATG GGA CAT ACG ATG, both of which sequences encode the amino acid sequence MGHTM, which corresponds to amino acids 1–5 of SEQ ID NO:48.

One of ordinary skill in the art will recognize that each codon in a nucleic acid (except AUG and UGC, which are ordinarily the only codon for methionine and tryptophan, respectively) can be modified by standard techniques to encode a functionally identical polypeptide. Accordingly, each silent variation of a nucleic acid which encodes a polypeptide is implicit in any described sequence. The invention also provides each and every possible variation of a nucleic acid sequence encoding a polypeptide of the invention that can be made by selecting combinations based on possible codon choices. These combinations are made in accordance with the standard triplet genetic code (codon) (e.g., as set forth in Table 1), as applied to the nucleic acid sequence encoding a polypeptide of the invention or fragment thereof. All such variations of every nucleic acid herein are specifically provided and described by consideration of the sequence in combination with the genetic code. One of skill is fully able to generate any silent substitution of the sequences listed herein.

Conservative Variations

"Conservatively modified variations," or simply "conservative variations," of a particular nucleic acid sequence refer to those nucleic acid sequences that encode identical or essentially identical amino acid sequences, or, where the nucleic acid does not encode an amino acid sequence, to essentially identical sequences. One of skill will recognize that individual substitutions, deletions or additions which alter, add or delete a single amino acid or a small percentage of amino acids (typically less than 5%, more typically less than 4%, 2% or 1%) in an encoded sequence of the invention are "conservatively modified variations" where the alterations result in the deletion, addition, and/or substitution of an amino acid with a chemically similar amino acid.

Conservative substitution tables providing functionally similar amino acids are well known in the art. Table 2 sets forth six exemplary groups that contain amino acids that are "conservative substitutions" for one another.

TABLE 2

Conservative Substitution Groups

| | | | | |
|---|---|---|---|---|
| 1 | Alanine (A) | Serine (S) | Threonine (T) | |
| 2 | Aspartic acid (D) | Glutamic acid (E) | | |
| 3 | Asparagine (N) | Glutamine (Q) | | |
| 4 | Arginine (R) | Lysine (K) | | |
| 5 | Isoleucine (I) | Leucine (L) | Methionine (M) | Valine (V) |
| 6 | Phenylalanine (F) | Tyrosine (Y) | Tryptophan (W) | |

Additional groups of amino acids can also be formulated. For example, amino acids can be grouped by similar function or chemical structure or composition (e.g., acidic, basic, aliphatic, aromatic, sulfur-containing). For example, an aliphatic grouping may comprise: Glycine (G), Alanine, Valine, Leucine, Isoleucine. Other groups containing amino acids that are conservative substitutions for one another include: Aromatic: Phenylalanine (F), Tyrosine (Y), Tryptophan (W); Sulfur-containing: Methionine (M), Cysteine (C); Basic: Arginine (R), Lysine (K), Histidine (H); Acidic: Aspartic acid (D), Glutamic acid (E), Asparagine (N), Glutamine (Q). See also Creighton (1984) Proteins, W. H. Freeman and Company, for additional groupings of amino acids.

Thus, "conservatively substituted variations" of a polypeptide sequence of the present invention include substitutions of a small percentage, typically less than 5%, more typically less than 4%, 3%, 2%, or 1%, of the amino acids of the sequence, with a conservatively selected amino acid of the same conservative substitution group.

For example, a conservatively substituted variation of the polypeptide identified herein as SEQ ID NO:48 may contain "conservative substitutions," according to the six groups defined above, in up to 15 residues (i.e., 5% of the amino acids) in the 296 amino acid polypeptide. Listing of a polypeptide or protein sequence herein, in conjunction with the above substitution table, provides an express listing of all conservatively substituted polypeptide or protein sequences.

In a further example, if four conservative substitutions were localized in the region corresponding to amino acids 69–94 of SEQ ID NO:48, examples of conservatively substituted variations of this region, QKDSK MVLAI LPGKV QVWPE YKNRTI, would include:

NKDSK MVVAI LPGKV QVFPE YKNKTI and

QKDAK MVLAI LPGRV QMWPE YKQRTI and the like, where conservative substitutions listed in Table 2 (in the above example, conservative substitutions are underlined). Listing of a polypeptide or protein sequence herein, in conjunction with the above substitution table, provides an express listing of all conservatively substituted polypeptide or protein sequences.

The addition of one or more nucleic acids or sequences that do not alter the encoded activity of a nucleic acid molecule of the invention, such as the addition of a non-functional sequence, is a conservative variation of the basic nucleic acid molecule, and the addition of one or more amino acid residues that do not alter the activity of a polypeptide of the invention is a conservative variation of the basic polypeptide. Both such types of additions are features of the invention.

One of skill will appreciate that many conservative variations of the nucleic acid sequence constructs that are disclosed yield a functionally identical construct. For example, as discussed above, owing to the degeneracy of the genetic code, "silent substitutions" (i.e., substitutions in a nucleic acid sequence which do not result in an alteration in an encoded polypeptide) are an implied feature of every nucleic acid sequence that encodes an amino acid. Similarly, "conservative amino acid substitutions," in one or a few amino acids in an amino acid sequence are substituted with different amino acids with highly similar properties, are also readily identified as being highly similar to a disclosed construct. Such conservative variations of each disclosed sequence are a feature of the present invention.

Nucleic Acid Hybridization

Nucleic acids "hybridize" when they associate, typically in solution. Nucleic acids hybridize due to a variety of well characterized physico-chemical forces, such as hydrogen bonding, solvent exclusion, base stacking and the like. An extensive guide to the hybridization of nucleic acids is found in Tijssen (1993) *Laboratory Techniques in Biochemistry and Molecular Biology—Hybridization with Nucleic Acid Probes*, part I, chapter 2, "Overview of principles of hybridization and the strategy of nucleic acid probe assays," (Elsevier, New York) (hereinafter "Tjissen"), as well as in Ausubel, supra, Hames and Higgins (1995) *Gene Probes* 1, IRL Press at Oxford University Press, Oxford, England (Hames and Higgins 1) and Hames and Higgins (1995) *Gene Probes* 2, IRL Press at Oxford University Press, Oxford, England (Hames and Higgins 2) provide details on the synthesis, labeling, detection and quantification of DNA and RNA, including oligonucleotides.

An indication that two nucleic acid sequences are substantially identical is that the two molecules hybridize to each other under at least stringent conditions. The phrase "hybridizing specifically to," refers to the binding, duplexing, or hybridizing of a molecule only to a particular nucleotide sequence under stringent conditions when that sequence is present in a complex mixture (e.g., total cellular) DNA or RNA. "Bind(s) substantially" refers to complementary hybridization between a probe nucleic acid and a target nucleic acid and embraces minor mismatches that can be accommodated by reducing the stringency of the hybridization media to achieve the desired detection of the target polynucleotide sequence.

"Stringent hybridization wash conditions" and "stringent hybridization conditions" in the context of nucleic acid hybridization experiments, such as Southern and northern hybridizations, are sequence dependent, and are different under different environmental parameters. An extensive guide to hybridization of nucleic acids is found in Tijssen (1993), supra, and in Hames and Higgins 1 and Hames and Higgins 2, supra.

For purposes of the present invention, generally, "highly stringent" hybridization and wash conditions are selected to be about 5° C. or less lower than the thermal melting point ($T_m$) for the specific sequence at a defined ionic strength and pH (as noted below, highly stringent conditions can also be referred to in comparative terms). The $T_m$ is the temperature (under defined ionic strength and pH) at which 50% of the test sequence hybridizes to a perfectly matched probe. In other words, the $T_m$ indicates the temperature at which the nucleic acid duplex is 50% denatured under the given conditions and its represents a direct measure of the stability of the nucleic acid hybrid. Thus, the $T_m$ corresponds to the temperature corresponding to the midpoint in transition from helix to random coil; it depends on length, nucleotide composition, and ionic strength for long stretches of nucleotides. Typically, under "stringent conditions," a probe will hybridize to its target subsequence, but to no other sequences. "Very stringent conditions" are selected to be equal to the $T_m$ for a particular probe.

After hybridization, unhybridized nucleic acid material can be removed by a series of washes, the stringency of which can be adjusted depending upon the desired results. Low stringency washing conditions (e.g., using higher salt and lower temperature) increase sensitivity, but can product nonspecific hybridization signals and high background signals. Higher stringency conditions (e.g., using lower salt and higher temperature that is closer to the hybridization temperature) lowers the background signal, typically with only the specific signal remaining. See, Rapley, R. and Walker, J. M. eds., *Molecular Biomethods Handbook* (Humana Press, Inc. 1998) (hereinafter "Rapley and Walker"), which is incorporated herein by reference in its entirety for all purposes.

The $T_m$ of a DNA-DNA duplex can be estimated using equation (1):

$$T_m(°\ C.)=81.5°\ C.+16.6\ (\log_{10}M)+0.41\ (\%\ G+C)-0.72\ (\%\ f)-500/n,$$

where M is the molarity of the monovalent cations (usually Na+), (% G+C) is the percentage of guanosine (G) and cystosine (C) nucleotides, (% f) is the percentage of formalize and n is the number of nucleotide bases (i.e., length) of the hybrid. See, Rapley and Walker, supra.

The $T_m$ of an RNA-DNA duplex can be estimated using equation (2):

$$T_m(°\ C.)=79.8°\ C.+18.5\ (\log_{10}M)+0.58\ (\%\ G+C)-11.8(\%\ G+C)^2-0.56\ (\%\ f)-820/n,$$

where M is the molarity of the monovalent cations (usually Na+), (% G+C) is the percentage of guanosine (G) and cystosine (C) nucleotides, (% f) is the percentage of formamide and n is the number of nucleotide bases (i.e., length) of the hybrid. Id. Equations 1 and 2 above are typically accurate only for hybrid duplexes longer than about 100–200 nucleotides. Id.

The Tm of nucleic acid sequences shorter than 50 nucleotides can be calculated as follows:

$T_m(° C.)=4(G+C)+2(A+T)$, where A (adenine), C, T (thymine), and G are the numbers of the corresponding nucleotides.

An example of stringent hybridization conditions for hybridization of complementary nucleic acids which have more than 100 complementary residues on a filter in a Southern or northern blot is 50% formalin (or formamide) with 1 mg of heparin at 42° C., with the hybridization being carried out overnight. An example of stringent wash conditions is a 0.2×SSC wash at 65° C. for 15 minutes (see Sambrook, supra, for a description of SSC buffer). Often, the high stringency wash is preceded by a low stringency wash to remove background probe signal. An example low stringency wash is 2×SSC at 40° C. for 15 minutes. An example of highly stringent wash conditions is 0.15M NaCl at 72° C. for about 15 minutes. An example medium stringency wash for a duplex of, e.g., more than 100 nucleotides, is 1×SSC at 45° C. for 15 minutes. An example low stringency wash for a duplex of, e.g., more than 100 nucleotides, is 4–6×SSC at 40° C. for 15 minutes. For short probes (e.g., about 10 to 50 nucleotides), stringent conditions typically involve salt concentrations of less than about 1.0 M Na$^+$ ion, typically about 0.01 to 1.0 M Na$^+$ ion concentration (or other salts) at pH 7.0 to 8.3, and the temperature is typically at least about 30° C. Stringent conditions can also be achieved with the addition of destabilizing agents such as formamide.

In general, a signal to noise ratio of 2× or 2.5×–5× (or higher) than that observed for an unrelated probe in the particular hybridization assay indicates detection of a specific hybridization. Detection of at least stringent hybridization between two sequences in the context of the present invention indicates relatively strong structural similarity or homology to, e.g., the nucleic acids of the present invention provided in the sequence listings herein.

As noted, "highly stringent" conditions are selected to be about 5° C. or less lower than the thermal melting point ($T_m$) for the specific sequence at a defined ionic strength and pH. Target sequences that are closely related or identical to the nucleotide sequence of interest (e.g., "probe") can be identified under highly stringency conditions. Lower stringency conditions are appropriate for sequences that are less complementary. See, e.g., Rapley and Walker; Sambrook, all supra.

Comparative hybridization can be used to identify nucleic acids of the invention, and this comparative hybridization method is a preferred method of distinguishing nucleic acids of the invention. Detection of highly stringent hybridization between two nucleotide sequences in the context of the present invention indicates relatively strong structural similarity/homology to, e.g., the nucleic acids provided in the sequence listing herein. Highly stringent hybridization between two nucleotide sequences demonstrates a degree of similarity or homology of structure, nucleotide base composition, arrangement or order that is greater than that detected by stringent hybridization conditions. In particular, detection of highly stringent hybridization in the context of the present invention indicates strong structural similarity or structural homology (e.g., nucleotide structure, base composition, arrangement or order) to, e.g., the nucleic acids provided in the sequence listings herein. For example, it is desirable to identify test nucleic acids which hybridize to the exemplar nucleic acids herein under stringent conditions.

Thus, one measure of stringent hybridization is the ability to hybridize to one of the listed nucleic acids of the invention (e.g., nucleic acid sequences SEQ ID NOS:1–47, 95–173, and 253–262, and complementary polynucleotide sequences thereof) under highly stringent conditions (or very stringent conditions, or ultra-high stringency hybridization conditions, or ultra-ultra high stringency hybridization conditions). Stringent hybridization (including, e.g., highly stringent, ultra-high stringency, or ultra-ultra high stringency hybridization conditions) and wash conditions can easily be determined empirically for any test nucleic acid.

For example, in determining highly stringent hybridization and wash conditions, the hybridization and wash conditions are gradually increased (e.g., by increasing temperature, decreasing salt concentration, increasing detergent concentration and/or increasing the concentration of organic solvents, such as formalin, in the hybridization or wash), until a selected set of criteria are met. For example, the hybridization and wash conditions are gradually increased until a probe comprising one or more nucleic acid sequences selected from SEQ ID NOS:1–47, 95–173, and 253–262, and complementary polynucleotide sequences thereof, binds to a perfectly matched complementary target (again, a nucleic acid comprising one or more nucleic acid sequences selected from SEQ ID NOS:1–47, 95–173, and 253–262, and complementary polynucleotide sequences thereof), with a signal to noise ratio that is at least 2.5×, and optionally 5× or more as high as that observed for hybridization of the probe to an unmatched target. In this case, the unmatched target is a nucleic acid corresponding to, e.g., a known B7-1 or related known co-stimulatory homologue or the like, e.g., a B7-1 nucleic acid (other than those in the accompanying sequence listing) present in a public database such as GenBank™ at the time of filing of the subject application. Examples of such unmatched target nucleic acids include, e.g., the following: A92749, A92750, AA983817, AB026121, AB030650, AB030651, AB038153, AF010465, AF065893, AF065894, AF065895, AF065896, AF079519, AF106824, AF106825, AF106828, AF106829, AF106830, AF106831, AF106832, AF106833, AF106834, AF203442, AF203443, AF216747, AF257653, AH004645, AH008762, AX000904, AX000905, D49843, L12586, L12587, M27533, M83073, M83074, M83075, M83077, NM005191, S74541, S74540, S74695, S74696, U05593, U10925, U19833, U19840, U26832, U33063, U33208, U57755, U88622, X60958, Y08823, and Y09950, where the numbers correspond to GenBank accession numbers. Additional such sequences can be identified in GenBank by one of ordinary skill in the art.

A test nucleic acid is said to specifically hybridize to a probe nucleic acid when it hybridizes at least ½ as well to the probe as to the perfectly matched complementary target, i.e., with a signal to noise ratio at least ½ as high as hybridization of the probe to the target under conditions in which the perfectly matched probe binds to the perfectly matched complementary target with a signal to noise ratio that is at least about 2.5×–10×, typically 5×–10× as high as that observed for hybridization to any of the unmatched target nucleic acids such as, A92749, A92750, AA983817, AB026121, AB030650, AB030651, AB038153, AF010465, AF065893, AF065894, AF065895, AF065896, AF079519, AF106824, AF106825, AF106828, AF106829, AF106830, AF106831, AF106832, AF106833, AF106834, AF203442, AF203443, AF216747, AF257653, AH004645, AH008762, AX000904, AX000905, D49843, L12586, L12587, M27533, M83073, M83074, M83075, M83077, NM005191, S74541, S74540, S74695, S74696, U05593, U10925, U19833, U19840, U26832, U33063, U33208, U57755, U88622, X60958, Y08823, and Y09950 (where the numbers correspond to GenBank accession numbers), or, e.g., other similar known B7-1 or related co-stimulatory sequences or the like presented in GenBank. In one aspect, the invention provides a target nucleic acid that hybridizes under stringent conditions to a unique coding oligonucleotide that encodes a unique subsequence in a polypeptide selected from SEQ ID NOS:48–94, 174–252, 263–272, and 283–293, where the unique subsequence is unique compared to a polypeptide encoded by any of above GenBank Nucleotide Access Nos. For some such nucleic acids, the stringent conditions are selected such that a perfectly complementary oligonucleotide to the coding oligonucleotide hybridizes to the coding oligonucleotide with at least about a 5× higher signal to noise ratio than for hybridization of the perfectly complementary oligonucleotide to a control nucleic acid corresponding to any of GenBank Nucleotide Accession Nos. set forth above.

Ultra high-stringency hybridization and wash conditions are those in which the stringency of hybridization and wash conditions are increased until the signal to noise ratio for binding of the probe to the perfectly matched complementary target nucleic acid is at least 10× as high as that observed for hybridization to any of the unmatched target nucleic acids, such as, A92749, A92750, AA983817, AB026121, AB030650, AB030651, AB038153, AF010465, AF065893, AF065894, AF065895, AF065896, AF079519, AF106824, AF106825, AF106828, AF106829, AF106830, AF106831, AF106832, AF106833, AF106834, AF203442, AF203443, AF216747, AF257653, AH004645, AH008762, AX000904, AX000905, D49843, L12586, L12587, M27533, M83073, M83074, M83075, M83077, NM005191, S74541, S74540, S74695, S74696, U05593, U10925, U19833, U19840, U26832, U33063, U33208, U57755, U88622, X60958, Y08823, and Y09950 (where the numbers correspond to GenBank accession numbers), or, e.g., to other similar known B7-1 or co-stimulatory molecule sequences or the like presented in GenBank. A target nucleic acid which hybridizes to a probe under such conditions, with a signal to noise ratio of at least ½ that of the perfectly matched complementary target nucleic acid is said to bind to the probe under ultra-high stringency conditions.

Similarly, even higher levels of stringency can be determined by gradually increasing the hybridization and/or wash conditions of the relevant hybridization assay. For example, those in which the stringency of hybridization and wash conditions are increased until the signal to noise ratio for binding of the probe to the perfectly matched complementary target nucleic acid is at least 10×, 20×, 50×, 100×, or 500× or more as high as that observed for hybridization to any of the unmatched target nucleic acids, such as those represented by: A92749, A92750, AA983817, AB026121, AB030650, AB030651, AB038153, AF010465, AF065893, AF065894, AF065895, AF065896, AF079519, AF106824, AF106825, AF106828, AF106829, AF106830, AF106831, AF106832, AF106833, AF106834, AF203442, AF203443, AF216747, AF257653, AH004645, AH008762, AX000904, AX000905, D49843, L12586, L12587, M27533, M83073, M83074, M83075, M83077, NM005191, S74541, S74540, S74695, S74696, U05593, U10925, U19833, U19840, U26832, U33063, U33208, U57755, U88622, X60958, Y08823, and Y09950 (where the numbers correspond to GenBank accession numbers), or, e.g., other similar B7-1 or co-stimulatory sequences or the like presented in GenBank can be identified. A target nucleic acid which hybridizes to a probe under such conditions, with a signal to noise ratio of at least ½ that of the perfectly matched complementary target nucleic acid is said to bind to the probe under ultra-ultra-high stringency conditions.

Target nucleic acids which hybridize to the nucleic acids represented by SEQ ID NOS:1–47, 95–173, and 253–262 under high, ultra-high and ultra-ultra high stringency conditions are a feature of the invention. Examples of such nucleic acids include those with one or a few silent or conservative nucleic acid substitutions as compared to a given nucleic acid sequence.

Nucleic acids that do not hybridize to each other under stringent conditions are still substantially identical if the polypeptides that they encode are substantially identical. This occurs, e.g., when a copy of a nucleic acid is created using the maximum codon degeneracy permitted by the genetic code, or when antisera generated against one or more of SEQ ID NOS:48–94, 174–252, 263–272, and 283–293, which has been subtracted using the polypeptides encoded by known or existing B7-1 or similar or related co-stimulatory sequences or the like, including, e.g., those encoded by the following: A92749, A92750, AA983817, AB026121, AB030650, AB030651, AB038153, AF010465, AF065893, AF065894, AF065895, AF065896, AF079519, AF106824, AF106825, AF106828, AF106829, AF106830, AF106831, AF106832, AF106833, AF106834, AF203442, AF203443, AF216747, AF257653, AH004645, AH008762, AX000904, AX000905, D49843, L12586, L12587, M27533, M83073, M83074, M83075, M83077, NM005191, S74541, S74540, S74695, S74696, U05593, U10925, U19833, U19840, U26832, U33063, U33208, U57755, U88622, X60958, Y08823, and Y09950 (where the numbers correspond to GenBank accession numbers), or, e.g., other similar B7-1, co-stimulatory sequences, or the like presented in, e.g., GenBank. Further details on immunological identification of polypeptides of the invention are found below. Additionally, for distinguishing between duplexes with sequences of less than about 100 nucleotides, a TMAC1 hybridization procedure known to those of skill in the art can be used. See, e.g., Sorg, U. et al. 1 *Nucleic Acids Res.* (Sep. 11, 1991) 19(17), incorporated herein by reference in its entirety for all purposes.

In one aspect, the invention provides a nucleic acid which comprises a unique subsequence in a nucleic acid selected from any of SEQ ID NOS:1–47, 95–173, and 253–262. The unique subsequence is unique as compared to a nucleic acid corresponding to any of, e.g., A92749, A92750, AA983817, AB026121, AB030650, AB030651, AB038153, AF010465, AF065893, AF065894, AF065895, AF065896, AF079519, AF106824, AF106825, AF106828, AF106829, AF106830, AF106831, AF106832, AF106833, AF106834, AF203442, AF203443, AF216747, AF257653, AH004645, AH008762, AX000904, AX000905, D49843, L12586, L12587, M27533, M83073, M83074, M83075, M83077, NM005191, S74541, S74540, S74695, S74696, U05593, U10925, U19833, U19840, U26832, U33063, U33208, U57755, U88622, X60958, Y08823, and Y09950 (where the numbers correspond to GenBank accession numbers), or, e.g., other similar B7-1 or co-stimulatory sequences or the like presented in GenBank. Such unique subsequences can be determined by aligning any of SEQ ID NOS:1–47, 95–173, and 253–262 against the complete set of nucleic acids, e.g., those corresponding to, e.g., A92749, A92750, AA983817, AB026121, AB030650, AB030651, AB038153, AF010465, AF065893, AF065894, AF065895, AF065896, AF079519, AF106824, AF106825, AF106828, AF106829, AF106830, AF106831, AF106832, AF106833, AF106834, AF203442, AF203443, AF216747, AF257653, AH004645, AH008762, AX000904, AX000905, D49843, L12586, L12587, M27533, M83073, M83074, M83075, M83077, NM005191, S74541, S74540, S74695, S74696, U05593, U10925, U19833, U19840, U26832, U33063, U33208, U57755, U88622, X60958, Y08823, and Y09950, or other sequences available, e.g., in a public database, at the filing date of the subject application. Alignment can be performed using the BLAST algorithm set to default parameters. Any unique subsequence is useful, e.g., as a probe to identify the nucleic acids of the invention.

Similarly, the invention includes a polypeptide which comprises a unique amino acid subsequence in a polypeptide selected from any of SEQ ID NOS:48–94, 174–252, 263–272, and 283–293. Here, the unique subsequence is unique as compared to a polypeptide or amino acid sequence corresponding to, e.g., any of A92749, A92750, AA983817, AB026121, AB030650, AB030651, AB038153, AF010465, AF065893, AF065894, AF065895, AF065896, AF079519, AF106824, AF106825, AF106828, AF106829, AF106830, AF106831, AF106832, AF106833, AF106834, AF203442, AF203443, AF216747, AF257653, AH004645, AH008762, AX000904, AX000905, D49843, L12586, L12587, M27533, M83073, M83074, M83075, M83077, NM005191, S74541, S74540, S74695, S74696, U05593, U10925, U19833, U19840, U26832, U33063, U33208, U57755, U88622, X60958, Y08823, and Y09950 (where the numbers correspond to GenBank accession numbers). Here again, the polypeptide is aligned against the existing polypeptides (the control polypeptides). Note that where the sequence corresponds to a non-translated sequence such as a pseudo-gene, the corresponding polypeptide is generated simply by in silico translation of the nucleic acid sequence into an amino acid sequence, where the reading frame is selected to correspond to the reading frame of homologous NCSM nucleic acids. Such polypeptides are optionally made by synthetic or recombinant approaches, or can even be ordered from companies specializing in polypeptide production.

In addition, the present invention provides a target nucleic acid which hybridizes under at least stringent or highly stringent conditions (or conditions of greater stringency) to a unique coding oligonucleotide which encodes a unique subsequence in a polypeptide selected from any of SEQ ID NOS:48–94, 174–252, 263–272, and 283–293, wherein the unique subsequence is unique as compared to a an amino acid subsequence of a known B7-1 or related co-stimulatory polypeptide sequence or the like shown in GenBank or to a polypeptide corresponding to any of the control polypeptides. Unique sequences are determined as noted above.

In one example, the stringent conditions are selected such that a perfectly complementary oligonucleotide to the coding oligonucleotide hybridizes to the coding oligonucleotide with at least about a 5–10× higher signal to noise ratio than for hybridization of the perfectly complementary oligonucleotide to a control nucleic acid corresponding to any of the control polypeptides. Conditions can be selected such that higher ratios of signal to noise are observed in the particular assay that is used, e.g., about 15×, 20×, 30×, 50× or more. In this example, the target nucleic acid hybridizes to the unique coding oligonucleotide with at least a 2× higher signal to noise ratio as compared to hybridization of the control nucleic acid to the coding oligonucleotide. Again, higher signal to noise ratios can be selected, e.g., about 2.5×, about 5×, about 10×, about 20×, about 30×, about 50× or more. The particular signal depends on the label used in the relevant assay, e.g., a fluorescent label, colorimetric label, radio active label, or the like.

In another aspect, the invention provides a polypeptide comprising a unique subsequence in a polypeptide selected from any of SEQ ID NOS:48–94, 174–252, 263–272, and 283–293, wherein the unique subsequence is unique as compared to a polypeptide sequence corresponding to a known B7-1, co-stimulatory polypeptide or the like, such as, e.g., a B7-1 or co-stimulatory polypeptide sequence present in GenBank.

Percent Sequence Identity—Sequence Similarity

The degree to which one nucleic acid is similar to another provides an indication of whether there is an evolutionary relationship between the two or more nucleic acids. In particular, where a high level of sequence identity is observed, it is inferred that the nucleic acids are derived from a common ancestor (i.e., that the nucleic acids are homologous). In addition, sequence similarity implies similar structural and functional properties for the two or more nucleic acids and the sequences they encode. Accordingly, in the context of the present invention, sequences which have a similar sequence to any given exemplar sequence are a feature of the present invention. In particular, sequences that have share percent sequence identities as defined below are a feature of the invention.

A variety of methods of determining sequence relationships can be used, including manual alignment and computer assisted sequence alignment and analysis. This later approach is a preferred approach in the present invention, due to the increased throughput afforded by computer-assisted methods. A variety of computer programs for performing sequence alignment are available, or can be produced by one of skill.

As noted above, the sequences of the nucleic acids and polypeptides (and fragments thereof) employed in the subject invention need not be identical, but can be substantially identical (or substantially similar), to the corresponding sequence of a NCSM polypeptide or nucleic acid molecule (or fragment thereof) or related molecule. For example, the polypeptides can be subject to various changes, such as one or more amino acid or nucleic acid insertions, deletions, and substitutions, either conservative or non-conservative, including where, e.g., such changes might provide for certain advantages in their use, e.g., in their therapeutic or prophylactic use or administration or diagnostic application. The nucleic acids can also be subject to various changes, such as one or more substitutions of one or more nucleic acids in one or more codons such that a particular codon encodes the same or a different amino acid, resulting in either a conservative or non-conservative substitution, or one or more deletions of one or more nucleic acids in the sequence. The nucleic acids can also be modified to include one or more codons that provide for optimum expression in an expression system (e.g., mammalian cell or mammalian expression system), while, if desired, said one or more codons still encode the same amino acid(s). Such nucleic acid changes might provide for certain advantages in their therapeutic or prophylactic use or administration, or diagnostic application. The nucleic acids and polypeptides can be modified in a number of ways so long as they comprise a sequence substantially identical (as defined below) to a sequence in a respective NCSM nucleic acid or polypeptide molecule.

Alignment and comparison of relatively short amino acid sequences (less than about 30 residues) is typically straightforward. Comparison of longer sequences can require more sophisticated methods to achieve optimal alignment of two sequences. Optimal alignment of sequences for aligning a comparison window can be conducted by the local homology algorithm of Smith and Waterman (1981) *Adv Appl Math* 2:482, by the homology alignment algorithm of Needleman and Wunsch (1970) *J Mol Biol* 48:443, by the search for similarity method of Pearson and Lipman (1988) *Proc Natl Acad Sci USA* 85:2444, by computerized implementations of these algorithms (GAP, BESTFIT, FASTA and TFASTA in the Wisconsin Genetics Software Package Release 7.0, Genetics Computer Group, 575 Science Dr., Madison, Wis.; and BLAST, see, e.g., Altschul et al. (1977) *Nuc Acids Res* 25:3389–3402 and Altschul et al. (1990) *J Mol Biol* 215:403–410), or by inspection, with the best alignment (i.e., resulting in the highest percentage of sequence similarity or sequence identity over the comparison window) generated by the various methods being selected.

The term "identical" or percent "identity," in the context of two or more nucleic acid or polypeptide sequences, refers to two or more sequences or subsequences that are the same or have a specified percentage of amino acid residues or nucleotides that are the same, when compared and aligned for maximum correspondence, as measured using one of the following sequence comparison algorithms or by visual inspection.

The term "sequence identity" or "percent identity" ("% identity") means that two polynucleotide or polypeptide sequences are identical (i.e., on a nucleotide-by-nucleotide basis or amino acid-by-amino acid basis, respectively) over a window of comparison. The term "percentage of sequence identity" (or "percent sequence identity" or simply "percent identity" or "% identity") or "percentage of sequence similarity" (or "percent sequence similarity" or simply "percent similarity") is calculated by comparing two optimally aligned polynucleotide or polypeptide sequences over the window of comparison, determining the number of positions at which the identical residues occur in both sequences to yield the number of matched positions, dividing the number of matched positions by the total number of positions in the window of comparison (i.e., the window size), and multiplying the result by 100 to yield the percentage of sequence identity (or percentage of sequence similarity). Thus, for example, with regard to polypeptide sequences, the term sequence identity means that two polypeptide sequences are identical (on an amino acid-by-amino acid basis) over a window of comparison, and a percentage of amino acid residue sequence identity (or percentage of amino acid residue sequence similarity), can be calculated. For sequence comparison, typically one sequence acts as a reference sequence to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters. Maximum correspondence can be determined by using one of the sequence algorithms described herein (or other algorithms available to those of ordinary skill in the art) or by visual inspection.

The phrase "substantially identical" or "substantial identity" in the context of two nucleic acids or polypeptides, refers to two or more sequences or subsequences that have at least about 50%, 60%, 70%, 75%, preferably 80% or 85%, more preferably 90%, 91%, 92%, 93%, 94%, 95%, 96%, 97%, 98%, 99%, 99.5%, or more nucleotide or amino acid residue % identity, respectively, when compared and aligned for maximum correspondence, as measured using one of the following sequence comparison algorithms or by visual inspection. In certain embodiments, the substantial identity exists over a region of amino acid sequences that is at least about 50 residues in length, preferably over a region of at least about 100 residues in length, and more preferably the sequences are substantially identical over at least about 150, 200, or 250 amino acid residues. In certain aspects, substantial identity exists over a region of nucleic acid sequences of at least about 500 residues, preferably over a region of at least about 600 residues in length, and more preferably the sequences are substantially identical over at least about 700, 800, or 850 nucleic acid residues. In some aspects, the amino acid or nucleic acid sequences are substantially identical over the entire length of the corresponding coding region.

As applied to polypeptides and peptides, the term "substantial identity" typically means that two polypeptide or peptide sequences, when optimally aligned, such as by the programs GAP or BESTFIT using default gap weights (described in detail below) or by visual inspection, share at least about 60% or 70%, often at least 75%, preferably at least about 80% or 85%, more preferably at least about 90%, 91%, 92%, 93%, 94%, 95%, 96%, 97%, 98%, 99%, or 99.5% or more percent amino acid residue sequence identity or sequence similarity. Similarly, as applied in the context of two nucleic acids, the term substantial identity or substantial similarity means that the two nucleic acid sequences, when optimally aligned, such as by the programs BLAST, GAP or BESTFIT using default gap weights (described in detail below) or by visual inspection, share at least about 60 percent, 70 percent, or 80 percent sequence identity or sequence similarity, preferably at least about 90 percent amino acid residue sequence identity or sequence similarity, more preferably at least about 95 percent sequence identity or sequence similarity, or more (including, e.g., about 90, 91, 92, 93, 94, 95, 96, 97, 98, 98.5, 99, 99.5,or more percent nucleotide sequence identity or sequence similarity).

In one aspect, the present invention provides nucleic acids encoding NCSM amino acid molecules (e.g., full-length polypeptide, signal peptide, ECD, cytoplasmic domain, transmembrane domain, mature region, or other fragment) having at least about 60%, 70%, 75%, 80%, 85%, 90%, 91%, 92%, 93%, 94%, 95%, 96%, 97%, 98%, 98.5%, 99%, 99.5% or more percent sequence identity or sequence similarity with the nucleic acid of any of SEQ ID NOS:1–47, 95–173, and 253–262 or a fragment thereof, including, e.g., one or more of a signal peptide, ECD, cytoplasmic domain, transmembrane domain, or mature region or any combination thereof. Some such encoded polypeptides have the CD28BP or CTLA-4BP properties described herein.

In another aspect, the present invention provides NCSM polypeptides (e.g., full-length NCSM polypeptide, signal peptide, ECD, cytoplasmic domain, transmembrane domain, mature region, or other fragment), and fusion proteins comprising said polypeptides, having at least about 50%, 60%, 70%, 75%, 80%, 85%, 90%, 91%, 92%, 93%, 94%, 95%, 96%, 97%, 98%, 99%, 99.5% or more percent sequence identity or sequence similarity with the polypeptide of any of SEQ ID NOS:48–94, 174–252, 263–272, and 283–293 or a fragment thereof, including, e.g., one or more of a signal peptide, ECD, cytoplasmic domain, transmembrane domain, or mature region or any combination thereof.

Such fragments of SEQ ID NOS:69–92, 222–272, and 286–288 may have at least one CTLA4BP property described herein, such as, e.g., an ability to inhibit T cell proliferation or activation in conjunction with stimulation of T cell receptor (e.g., by antigen or antiCD3 Ab) and/or a CTLA-4/CD28 binding affinity ratio about equal to or greater than that of hB7-1. Such fragments of SEQ ID NOS:48–68, 174–221, 283–285, and 289–293 may have at least one CD28BP property described herein, such as, e.g., an ability to induce T cell proliferation or activation in conjunction with stimulation of T cell receptor (e.g., by antigen or antiCD3 Ab) and/or a CD28/CTLA-4 binding affinity ratio about equal to or greater than that of hB7-1. Such fragments of SEQ ID NOS:93–94 may have an ability to induce T cell proliferation or activation in conjunction with stimulation of T cell receptor (by, e.g., an antigen) and/or a CD28/CTLA-4 binding affinity ratio approximately equal to that of a primate, such as hB7-1.

In yet another aspect, the present invention provides NCSM homologue polypeptides that are substantially identical or substantially similar over at least about 150, 180, 170, 190, 200, 210, 225, 230, 240, 250, 275, or 285 or more contiguous amino acids of at least one of SEQ ID NOS: 69–92, 222–272, and 286–288; some such polypeptides may have an ability to inhibit T cell proliferation or activation and/or a CTLA-4/CD28 binding affinity ratio about equal to or greater than that of hB7-1 as described herein.

In yet another aspect, the present invention provides NCSM homologue polypeptides that are substantially identical or substantially similar over at least about 150, 180, 170, 190, 200, 210, 225, 230, 240, 250, 275, or 285 or more contiguous amino acids of at least one of SEQ ID NOS: 48–68, 174–221, 283–285, and 289–293; some such polypeptides may have an ability to induce T cell proliferation or activation in conjunction with stimulation of T cell receptor (e.g., by antigen or antiCD3 Ab) and/or a CD28/CTLA-4 binding affinity ratio about equal to or greater than that of hB7-1.

NCSM homologue polypeptides that are substantially identical or substantially similar over at least about 150, 180, 170, 190, 200, 210, 225, 230, 240, 250, 275, or 285 or more contiguous amino acids of at least one of SEQ ID NOS: 93–94; some such polypeptides may have an ability to induce T cell proliferation or activation in conjunction with stimulation of T cell receptor (by, e.g., antiCD3 Ab or antigen) and/or a CD28/CTLA-4 binding affinity ratio about equal to that of a primate, such as hB7-1.

A feature of the invention is a NCSM polypeptide comprising at least 175 contiguous amino acids of any one of SEQ ID NOS:48–94, 174–252, 263–272, and 283–293. In other embodiments, the polypeptide comprises about 175, 200, 210, 225, 275, or more contiguous amino acid residues of any one of SEQ ID NOS:48–94, 174–252, 263–272, and 283–293. In other embodiments, the polypeptide is at least about 280 amino acids, and still more preferably at least about 285 amino acids in length.

Alternatively, parameters are set such that one or more sequences of the invention are identified by alignment to a query sequence selected from among SEQ ID NOS:49–94, 174–252, 263–272 and 283–293, while sequences corresponding to unrelated polypeptides, e.g., those encoded by known nucleic acid sequences represented by GenBank accession numbers (e.g., known B7-1 sequences) are not identified.

Preferably, residue positions that are not identical differ by conservative amino acid substitutions. Conservative amino acid substitution refers to the interchange-ability of residues having similar side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Preferred conservative amino acids substitution groups are: valine-leucine-isoleucine, phenylalanine-tyrosine, lysine-arginine, alanine-valine, and asparagine-glutamine.

Alignment and comparison of relatively short amino acid sequences (less than about 30 residues) is typically straight-forward. Comparison of longer sequences can require more sophisticated methods to achieve optimal alignment of two sequences. Optimal alignment of sequences for aligning a comparison window can be conducted by the local homology algorithm of Smith and Waterman (1981) *Adv Appl Math* 2:482, by the homology alignment algorithm of Needleman and Wunsch (1970) *J Mol Biol* 48:443, by the search for similarity method of Pearson and Lipman (1988) *Proc Natl Acad Sci USA* 85:2444, by computerized implementations of these algorithms (GAP, BESTFIT, FASTA, and TFASTA in the Wisconsin Genetics Software Package Release 7.0, Genetics Computer Group, 575 Science Dr., Madison, Wis.), or by inspection, with the best alignment (i.e., resulting in the highest percentage of sequence similarity over the comparison window) generated by the various methods being selected.

A preferred example of an algorithm that is suitable for determining percent sequence identity (percent identity) and sequence similarity is the FASTA algorithm, which is described in Pearson, W. R. & Lipman, D. J. (1988) *Proc Natl Acad Sci USA* 85:2444. See also, W. R. Pearson (1996) *Methods Enzymology* 266:227–258. Preferred parameters used in a FASTA alignment of DNA sequences to calculate percent identity are optimized, BL50 Matrix 15: −5, k-tuple=2; joining penalty=40, optimization=28; gap penalty −12, gap length penalty=−2; and width=16.

Other preferred examples of algorithm that are suitable for determining percent sequence identity and sequence similarity are the BLAST and BLAST 2.0 algorithms, which are described in Altschul et al. (1997) *Nuc Acids Res* 25:3389–3402 and Altschul et al. (1990) *J Mol Biol* 215: 403–410, respectively. BLAST and BLAST 2.0 are used, with the parameters described herein, to determine percent sequence identity for the nucleic acids and proteins of the invention. Software for performing BLAST analyses is publicly available through the National Center for Biotechnology Information (http://www.ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4 and a comparison of both strands. For amino acid sequences, the BLASTP program (e.g., BLASTP 2.0.14; Jun. 29, 2000) uses as defaults a wordlength of 3, and expectation (E) of 10, and the BLOSUM62 scoring matrix (see, Henikoff & Henikoff (1989) *Proc Natl Acad Sci USA* 89:10915) uses alignments (B) of 50, expectation (E) of 10, M=5, N=−4, and a comparison of both strands. Again, as with other suitable algorithms, the stringency of comparison can be increased until the program identifies only sequences that are more closely related to those in the sequence listings herein (i.e., SEQ ID NOS: 1–47, 95–173, and 253–262 or, alternatively, SEQ ID NOS: 48–94, 174–252, 263–272, and 283–293, rather than sequences that are more closely related to other similar sequences such as, e.g., those nucleic acid sequences represented by GenBank accession numbers set forth herein, and or other similar molecules found in, e.g., GenBank. In other words, the stringency of comparison of the algorithms can be increased so that all known prior art (e.g., those represented by GenBank accession numbers shown herein, or other similar molecules found in, e.g., GenBank) is excluded.

The BLAST algorithm also performs a statistical analysis of the similarity or identity between two sequences (see, e.g., Karlin & Altschul (1993) *Proc Natl Acad Sci USA* 90:5873–5787). One measure of similarity provided by this algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

Another example of a useful algorithm is PILEUP. PILEUP creates a multiple sequence alignment from a group of related sequences using progressive, pairwise alignments to show relationship and percent sequence identity or percent sequence similarity. It also plots a tree or dendogram showing the clustering relationships used to create the alignment. PILEUP uses a simplification of the progressive alignment method of Feng & Doolittle (1987) *J Mol Evol* 35:351–360. The method used is similar to the method described by Higgins & Sharp (1989) *CABIOS* 5:151–153. The program can align up to 300 sequences, each of a maximum length of 5,000 nucleotides or amino acids. The multiple alignment procedure begins with the pairwise alignment of the two most similar sequences, producing a cluster of two aligned sequences. This cluster is then aligned to the next most related sequence or cluster of aligned sequences. Two clusters of sequences are aligned by a simple extension of the pairwise alignment of two individual sequences. The final alignment is achieved by a series of progressive, pairwise alignments. The program is run by designating specific sequences and their amino acid or nucleotide coordinates for regions of sequence comparison and by designating the program parameters. Using PILEUP, a reference sequence is compared to other test sequences to determine the percent sequence identity (or percent sequence similarity) relationship using the following parameters: default gap weight (3.00), default gap length weight (0.10), and weighted end gaps. PILEUP can be obtained from the GCG sequence analysis software package, e.g., version 7.0 (Devereaux et al. (1984) *Nuc Acids Res* 12:387–395).

Another preferred example of an algorithm that is suitable for multiple DNA and amino acid sequence alignments is the CLUSTALW program (Thompson, J. D. et al. (1994) *Nuc Acids Res* 22:4673–4680). CLUSTALW performs multiple pairwise comparisons between groups of sequences and assembles them into a multiple alignment based on homology. Gap open and Gap extension penalties were 10 and 0.05 respectively. For amino acid alignments, the BLOSUM algorithm can be used as a protein weight matrix (Henikoff and Henikoff (1992) *Proc Natl Acad Sci USA* 89:10915–10919). Another example of an algorithm suitable for multiple DNA and amino acid sequence alignments is the Jotun Hein method, Hein (1990), from within the MegaLine™ DNASTAR package (MegaLine™ Version 4.03, manufactured by DNASTAR, Inc.) used according to the manufacturer's instructions and default values specified in the program.

It will be understood by one of ordinary skill in the art, that the above discussion of search and alignment algorithms also applies to identification and evaluation of polynucleotide sequences, with the substitution of query sequences comprising nucleotide sequences, and where appropriate, selection of nucleic acid databases.

Substrates and Formats for Sequence Recombination

The polynucleotides of the invention and fragments thereof are optionally used as substrates for any of a variety of recombination and recursive sequence recombination reactions, in addition to their use in standard cloning methods as set forth in, e.g., Ausubel, Berger and Sambrook, e.g., to produce additional NCSM polynucleotides or fragments thereof that encode polypeptides and fragments thereof having with desired properties. A variety of such reactions are known, including those developed by the inventors and their co-workers.

DNA recombination is a method for generating and identifying new NCSM molecules, e.g., including those with altered relative binding capacities to either or both of CD28 and CTLA-4 receptor (as compared to, e.g., hB7-1) and altered functional activities, including, e.g., altered capacities to induce or inhibit T cell activation and/or differentiation, induce or inhibit cytokine production, and/or promote or inhibit anergy and/or tolerance as described herein.

A variety of diversity generating protocols for generating and identifying NCSM molecules having one of more of the properties described herein are available and described in the art. The procedures can be used separately, and/or in combination to produce one or more NCSM variants of a nucleic acid or set of nucleic acids, as well variants of encoded proteins. Individually and collectively, these procedures provide robust, widely applicable ways of generating diversified nucleic acids and sets of nucleic acids (including, e.g., nucleic acid libraries) useful, e.g., for the engineering or rapid evolution of nucleic acids, proteins, pathways, cells and/or organisms with new and/or improved characteristics. While distinctions and classifications are made in the course of the ensuing discussion for clarity, it will be appreciated that the techniques are often not mutually exclusive. Indeed, the various methods can be used singly or in combination, in parallel or in series, to access diverse sequence variants.

The result of any of the diversity generating procedures described herein can be the generation of one or more nucleic acids, which can be selected or screened for nucleic acids with or which confer desirable properties, or that encode proteins with or which confer desirable properties. Following diversification by one or more of the methods herein, or otherwise available to one of skill, any nucleic acids that are produced can be selected for a desired activity or property, e.g. ability to induce or inhibit T cell proliferation or activation, cytokine production, alter binding affinity to one or more of CD28 or CTLA-4 receptors. This can include identifying any activity that can be detected, for example, in an automated or automatable format, by any of the assays in the art and the assays of the invention discussed here and in the Example section below. A variety of related (or even unrelated) properties can be evaluated, in serial or in parallel, at the discretion of the practitioner.

Descriptions of a variety of diversity generating procedures for generating modified nucleic acid sequences that encode NCSM polypeptides as described herein are found in the following publications and the references cited therein: Soong, N. et al. (2000) "Molecular breeding of viruses" *Nat Genet* 25(4):436–439; Stemmer, et al. (1999) "Molecular breeding of viruses for targeting and other clinical properties" *Tumor Targeting* 4:1–4; Ness et al. (1999) "DNA Shuffling of subgenomic sequences of subtilisin" *Nature Biotechnology* 17:893–896; Chang et al. (1999) "Evolution of a cytokine using DNA family shuffling" *Nature Biotechnology* 17:793–797; Minshull and Stemmer (1999) "Protein evolution by molecular breeding" *Current Opinion in Chemical Biology* 3:284–290; Christians et al. (1999) "Directed evolution of thymidine kinase for AZT phosphorylation using DNA family shuffling" *Nature Biotechnology* 17:259–264; Crameri et al. (1998) "DNA shuffling of a family of genes from diverse species accelerates directed evolution" *Nature* 391:288–291; Crameri et al. (1997) "Molecular evolution of an arsenate detoxification pathway by DNA shuffling," *Nature Biotechnology* 15:436–438; Zhang et al. (1997) "Directed evolution of an effective fucosidase from a galactosidase by DNA shuffling and screening" *Proc. Natl. Acad. Sci. USA* 94:4504–4509; Patten et al. (1997) "Applications of DNA Shuffling to Pharmaceuticals and Vaccines" *Current Opinion in Biotechnology* 8:724–733; Crameri et al. (1996) "Construction and evolution of antibody-phage libraries by DNA shuffling" *Nature Medicine* 2:100–103; Crameri et al. (1996) "Improved green fluorescent protein by molecular evolution using DNA shuffling" *Nature Biotechnology* 14:315–319; Gates et al. (1996) "Affinity selective isolation of ligands from peptide libraries through display on a lac repressor 'headpiece dimer'" *Journal of Molecular Biology* 255:373–386; Stemmer (1996) "Sexual PCR and Assembly PCR" In: *The Encyclopedia of Molecular Biology*. VCH Publishers, New York. pp.447–457; Crameri and Stemmer (1995) "Combinatorial multiple cassette mutagenesis creates all the permutations of mutant and wildtype cassettes" *BioTechniques* 18:194–195; Stemmer et al., (1995) "Single-step assembly of a gene and entire plasmid form large numbers of oligodeoxy-ribonucleotides" *Gene,* 164:49–53; Stemmer (1995) "The Evolution of Molecular Computation" *Science* 270:1510; Stemmer (1995) "Searching Sequence Space" *Bio/Technology* 13:549–553; Stemmer (1994) "Rapid evolution of a protein in vitro by DNA shuffling" *Nature* 370:389–391; and Stemmer (1994) "DNA shuffling by random fragmentation and reassembly: In vitro recombination for molecular evolution." *Proc. Natl. Acad. Sci. USA* 91:10747–10751.

The term "shuffling" is used herein to indicate recombination between non-identical sequences, in some embodiments shuffling may include crossover via homologous recombination or via non-homologous recombination, such as via cre/lox and/or flp/frt systems. Shuffling can be carried out by employing a variety of different formats, including for example, in vitro and in vivo shuffling formats, in silico shuffling formats, shuffling formats that utilize either double-stranded or single-stranded templates, primer based shuffling formats, nucleic acid fragmentation-based shuffling formats, and oligonucleotide-mediated shuffling formats, all of which are based on recombination events between non-identical sequences and are described in more detail or referenced herein below, as well as other similar recombination-based formats.

Mutational methods of generating diversity include, for example, site-directed mutagenesis (Ling et al. (1997) "Approaches to DNA mutagenesis: an overview" *Anal Biochem.* 254(2):157–178; Dale et al. (1996) "Oligonucleotide-directed random mutagenesis using the phosphorothioate method" *Methods Mol. Biol.* 57:369–374; Smith (1985) "In vitro mutagenesis" *Ann. Rev. Genet.* 19:423–462; Botstein & Shortle (1985) "Strategies and applications of in vitro mutagenesis" *Science* 229:1193–1201; Carter (1986) "Site-directed mutagenesis" *Biochem. J.* 237:1–7; and Kunkel (1987) "The efficiency of oligonucleotide directed mutagenesis" in *Nucleic Acids & Molecular Biology* (Eckstein, F. and Lilley, D. M. J. eds., Springer Verlag, Berlin)); mutagenesis using uracil containing templates (Kunkel (1985) "Rapid and efficient site-specific mutagenesis without phenotypic selection" *Proc. Natl. Acad. Sci. USA* 82:488–492; Kunkel et al. (1987) "Rapid and efficient site-specific mutagenesis without phenotypic selection" *Methods in Enzymol.* 154, 367–382; and Bass et al. (1988) "Mutant Trp repressors with new DNA-binding specificities" *Science* 242:240–245); oligonucleotide-directed mutagenesis (*Methods in Enzymol.* 100:468–500 (1983); *Methods in Enzymol.* 154:329–350 (1987); Zoller & Smith (1982) "Oligonucleotide-directed mutagenesis using M13-derived vectors: an efficient and general procedure for the production of point mutations in any DNA fragment" *Nucleic Acids Res.* 10:6487–6500; Zoller & Smith (1983) "Oligonucleotide-directed mutagenesis of DNA fragments cloned into M13 vectors" *Methods in Enzymol.* 100:468–500; and Zoller & Smith (1987) "Oligonucleotide-directed mutagenesis: a simple method using two oligonucleotide primers and a single-stranded DNA template" *Methods in Enzymol.* 154: 329–350); phosphorothioate-modified DNA mutagenesis (Taylor et al. (1985) "The use of phosphorothioate-modified DNA in restriction enzyme reactions to prepare nicked DNA" *Nucl. Acids Res.* 13:8749–8764; Taylor et al. (1985) "The rapid generation of oligonucleotide-directed mutations at high frequency using phosphorothioate-modified DNA" *Nucl. Acids Res.* 13:8765–8787 (1985); Nakamaye & Eckstein (1986) "Inhibition of restriction endonuclease Nci I cleavage by phosphorothioate groups and its application to oligonucleotide-directed mutagenesis" *Nucl. Acids Res.* 14:9679–9698; Sayers et al. (1988) "Y-T Exonucleases in phosphorothioate-based oligonucleotide-directed mutagenesis" *Nucl. Acids Res.* 16:791–802; and Sayers et al. (1988) "Strand specific cleavage of phosphorothioate-containing DNA by reaction with restriction endonucleases in the presence of ethidium bromide" *Nucl. Acids Res.*

16:803–814); mutagenesis using gapped duplex DNA (Kramer et al. (1984) "The gapped duplex DNA approach to oligonucleotide-directed mutation construction" *Nucl. Acids Res.* 12:9441–9456; Kramer & Fritz (1987) *Methods in Enzymol.* "Oligonucleotide-directed construction of mutations via gapped duplex DNA" 154:350–367; Kramer et al. (1988) "Improved enzymatic in vitro reactions in the gapped duplex DNA approach to oligonucleotide-directed construction of mutations" *Nucl. Acids Res.* 16:7207; and Fritz et al. (1988) "Oligonucleotide-directed construction of mutations: a gapped duplex DNA procedure without enzymatic reactions in vitro" *Nucl. Acids Res.* 16:6987–6999).

Additional suitable methods include point mismatch repair (Kramer et al. (1984) "Point Mismatch Repair" *Cell* 38:879–887), mutagenesis using repair-deficient host strains (Carter et al. (1985) "Improved oligonucleotide site-directed mutagenesis using M13 vectors" *Nucl. Acids Res.* 13:4431–4443; and Carter (1987) "Improved oligonucleotide-directed mutagenesis using M13 vectors" *Methods in Enzymol.* 154:382–403), deletion mutagenesis (Eghtedarzadeh & Henikoff (1986) "Use of oligonucleotides to generate large deletions" *Nucl. Acids Res.* 14:5115), restriction-selection and restriction-purification (Wells et al. (1986) "Importance of hydrogen-bond formation in stabilizing the transition state of subtilisin" *Phil. Trans. R. Soc. Lond.* A 317:415–423), mutagenesis by total gene synthesis (Nambiar et al. (1984) "Total synthesis and cloning of a gene coding for the ribonuclease S protein" *Science* 223:1299–1301; Sakamar and Khorana (1988) "Total synthesis and expression of a gene for the a-subunit of bovine rod outer segment guanine nucleotide-binding protein (transducin)" *Nucl. Acids Res.* 14:6361–6372; Wells et al. (1985) "Cassette mutagenesis: an efficient method for generation of multiple mutations at defined sites" *Gene* 34:315–323; and Grundström et al. (1985) "Oligonucleotide-directed mutagenesis by microscale 'shot-gun' gene synthesis" *Nucl. Acids Res.* 13:3305–3316), double-strand break repair (Mandecki (1986) "Oligonucleotide-directed double-strand break repair in plasmids of *Escherichia coli*: a method for site-specific mutagenesis" *Proc. Natl. Acad. Sci. USA*, 83:7177–7181; and Arnold (1993) "Protein engineering for unusual environments" *Current Opinion in Biotechnology* 4:450–455). Additional details on many of the above methods can be found in *Methods in Enzymology* Volume 154, which also describes useful controls for trouble-shooting problems with various mutagenesis methods.

Additional details regarding various diversity generating methods can be found in the following U.S. patents, PCT publications and applications, and EPO publications: U.S. Pat. No. 5,605,793 to Stemmer (Feb. 25, 1997), "Methods for In Vitro Recombination;" U.S. Pat. No. 5,811,238 to Stemmer et al. (Sep. 22, 1998) "Methods for Generating Polynucleotides having Desired Characteristics by Iterative Selection and Recombination;" U.S. Pat. No. 5,830,721 to Stemmer et al. (Nov. 3, 1998), "DNA Mutagenesis by Random Fragmentation and Reassembly;" U.S. Pat. No. 5,834,252 to Stemmer, et al. (Nov. 10, 1998) "End-Complementary Polymerase Reaction;" U.S. Pat. No. 5,837,458 to Minshull, et al. (Nov. 17, 1998), "Methods and Compositions for Cellular and Metabolic Engineering;" WO 95/22625, Stemmer and Crameri, "Mutagenesis by Random Fragmentation and Reassembly;" WO 96/33207 by Stemmer and Lipschutz "End Complementary Polymerase Chain Reaction;" WO 97/20078 by Stemmer and Crameri "Methods for Generating Polynucleotides having Desired Characteristics by Iterative Selection and Recombination;" WO 97/35966 by Minshull and Stemmer, "Methods and Compositions for Cellular and Metabolic Engineering;" WO 99/41402 by Punnonen et al. "Targeting of Genetic Vaccine Vectors;" WO 99/41383 by Punnonen et al. "Antigen Library Immunization;" WO 99/41369 by Punnonen et al. "Genetic Vaccine Vector Engineering;" WO 99/41368 by Punnonen et al. "Optimization of Immunomodulatory Properties of Genetic Vaccines;" EP 752008 by Stemmer and Crameri, "DNA Mutagenesis by Random Fragmentation and Reassembly;" EP 0932670 by Stemmer "Evolving Cellular DNA Uptake by Recursive Sequence Recombination;" WO 99/23107 by Stemmer et al., "Modification of Virus Tropism and Host Range by Viral Genome Shuffling;" WO 99/21979 by Apt et al., "Human Papillomavirus Vectors;" WO 98/31837 by del Cardayre et al. "Evolution of Whole Cells and Organisms by Recursive Sequence Recombination;" WO 98/27230 by Patten and Stemmer, "Methods and Compositions for Polypeptide Engineering;" WO 98/27230 by Stemmer et al., "Methods for Optimization of Gene Therapy by Recursive Sequence Shuffling and Selection," WO 00/00632, "Methods for Generating Highly Diverse Libraries," WO 00/09679, "Methods for Obtaining in Vitro Recombined Polynucleotide Sequence Banks and Resulting Sequences," WO 98/42832 by Arnold et al., "Recombination of Polynucleotide Sequences Using Random or Defined Primers," WO 99/29902 by Arnold et al., "Method for Creating Polynucleotide and Polypeptide Sequences," WO 98/41653 by Vind, "An in Vitro Method for Construction of a DNA Library," WO 98/41622 by Borchert et al., "Method for Constructing a Library Using DNA Shuffling," and WO 98/42727 by Pati and Zarling, "Sequence Alterations using Homologous Recombination;" WO 00/18906 by Patten et al., "Shuffling of Codon-Altered Genes;" WO 00/04190 by del Cardayre et al. "Evolution of Whole Cells and Organisms by Recursive Recombination;" WO 00/42561 by Crameri et al., "Oligonucleotide Mediated Nucleic Acid Recombination;" WO 00/42559 by Selifonov and Stemmer "Methods of Populating Data Structures for Use in Evolutionary Simulations;" WO 00/42560 by Selifonov et al., "Methods for Making Character Strings, Polynucleotides & Polypeptides Having Desired Characteristics;" PCT/US00/26708 by Welch et al., "Use of Codon-Varied Oligonucleotide Synthesis for Synthetic Shuffling;" and PCT/US01/06775 "Single-Stranded Nucleic Acid Template-Mediated Recombination and Nucleic Acid Fragment Isolation" by Affholter.

Several different general classes of sequence modification methods, such as mutation, recombination, etc. are applicable to the present invention and set forth, e.g., in the references above and below. The following exemplify some of the different types of preferred formats for diversity generation in the context of the present invention, including, e.g., certain recombination based diversity generation formats.

Nucleic acids can be recombined in vitro by any of a variety of techniques discussed in the references above, including e.g., DNAse digestion of nucleic acids to be recombined followed by ligation and/or PCR reassembly of the nucleic acids. For example, sexual PCR mutagenesis can be used in which random (or pseudo random, or even non-random) fragmentation of the DNA molecule is followed by recombination, based on sequence similarity, between DNA molecules with different but related DNA sequences, in vitro, followed by fixation of the crossover by extension in a polymerase chain reaction. This process and many process variants is described in several of the references above, e.g., in Stemmer (1994) *Proc. Natl. Acad. Sci. USA* 91:10747–10751.

Similarly, nucleic acids can be recursively recombined in vivo, e.g., by allowing recombination to occur between nucleic acids in cells. Many such in vivo recombination formats are set forth in the references noted above. Such formats optionally provide direct recombination between nucleic acids of interest, or provide recombination between vectors, viruses, plasmids, etc., comprising the nucleic acids of interest, as well as other formats. Details regarding such procedures are found in the references noted above.

Whole genome recombination methods can also be used in which whole genomes of cells or other organisms are recombined, optionally including spiking of the genomic recombination mixtures with desired library components (e.g., genes corresponding to the pathways of the present invention). These methods have many applications, including those in which the identity of a target gene is not known. Details on such methods are found, e.g., in WO 98/31837 by del Cardayre et al. "Evolution of Whole Cells and Organisms by Recursive Sequence Recombination;" and in, e.g., PCT/US99/15972 by del Cardayre et al., also entitled "Evolution of Whole Cells and Organisms by Recursive Sequence Recombination."

Synthetic recombination methods can also be used, in which oligonucleotides corresponding to targets of interest are synthesized and reassembled in PCR or ligation reactions which include oligonucleotides which correspond to more than one parental nucleic acid, thereby generating new recombined nucleic acids. Oligonucleotides can be made by standard nucleotide addition methods, or can be made, e.g., by tri-nucleotide synthetic approaches. Details regarding such approaches are found in the references noted above, including, e.g., WO 00/42561 by Crameri et al., "Oligonucleotide Mediated Nucleic Acid Recombination;" PCT/US00/26708 by Welch et al., "Use of Codon-Varied Oligonucleotide Synthesis for Synthetic Shuffling;" WO 00/42560 by Selifonov et al., "Methods for Making Character Strings, Polynucleotides and Polypeptides Having Desired Characteristics;" and WO 00/42559 by Selifonov and Stemmer "Methods of Populating Data Structures for Use in Evolutionary Simulations."

In silico methods of recombination can be effected in which genetic algorithms are used in a computer to recombine sequence strings which correspond to homologous (or even non-homologous) nucleic acids. The resulting recombined sequence strings are optionally converted into nucleic acids by synthesis of nucleic acids which correspond to the recombined sequences, e.g., in concert with oligonucleotide synthesis/gene reassembly techniques. This approach can generate random, partially random or designed variants. Many details regarding in silico recombination, including the use of genetic algorithms, genetic operators and the like in computer systems, combined with generation of corresponding nucleic acids (and/or proteins), as well as combinations of designed nucleic acids and/or proteins (e.g., based on cross-over site selection) as well as designed, pseudo-random or random recombination methods are described in WO 00/42560 by Selifonov et al., "Methods for Making Character Strings, Polynucleotides and Polypeptides Having Desired Characteristics" and WO 00/42559 by Selifonov and Stemmer "Methods of Populating Data Structures for Use in Evolutionary Simulations." Extensive details regarding in silico recombination methods are found in these applications. This methodology is generally applicable to the present invention in providing for recombination of the co-stimulatory and NCSM molecules in silico and/or the generation of corresponding nucleic acids or proteins.

Many methods of accessing natural diversity, e.g., by hybridization of diverse nucleic acids or nucleic acid fragments to single-stranded templates, followed by polymerization and/or ligation to regenerate full-length sequences, optionally followed by degradation of the templates and recovery of the resulting modified nucleic acids can be similarly used. In one method employing a single-stranded template, the fragment population derived from the genomic library(ies) is annealed with partial, or, often approximately full length ssDNA or RNA corresponding to the opposite strand. Assembly of complex chimeric genes from this population is then mediated by nuclease-base removal of non-hybridizing fragment ends, polymerization to fill gaps between such fragments and subsequent single stranded ligation. The parental polynucleotide strand can be removed by digestion (e.g., if RNA or uracil-containing), magnetic separation under denaturing conditions (if labeled in a manner conducive to such separation) and other available separation/purification methods. Alternatively, the parental strand is optionally co-purified with the chimeric strands and removed during subsequent screening and processing steps. Additional details regarding this approach are found, e.g., in "Single-Stranded Nucleic Acid Template-Mediated Recombination and Nucleic Acid Fragment Isolation" by Affholter, PCT/US01/06775.

In another approach, single-stranded molecules are converted to double-stranded DNA (dsDNA) and the dsDNA molecules are bound to a solid support by ligand-mediated binding. After separation of unbound DNA, the selected DNA molecules are released from the support and introduced into a suitable host cell to generate a library enriched sequences which hybridize to the probe. A library produced in this manner provides a desirable substrate for further diversification using any of the procedures described herein.

Any of the preceding general recombination formats can be practiced in a reiterative fashion (e.g., one or more cycles of mutation/recombination or other diversity generation methods, optionally followed by one or more selection methods) to generate a more diverse set of recombinant nucleic acids.

Mutagenesis employing polynucleotide chain termination methods have also been proposed (see e.g., U.S. Pat. No. 5,965,408, "Method of DNA reassembly by interrupting synthesis" to Short, and the references above), and can be applied to the present invention. In this approach, double stranded DNAs corresponding to one or more genes sharing regions of sequence similarity are combined and denatured, in the presence or absence of primers specific for the gene. The single stranded polynucleotides are then annealed and incubated in the presence of a polymerase and a chain terminating reagent (e.g., ultraviolet, gamma or X-ray irradiation; ethidium bromide or other intercalators; DNA binding proteins, such as single strand binding proteins, transcription activating factors, or histones; polycyclic aromatic hydrocarbons; trivalent chromium or a trivalent chromium salt; or abbreviated polymerization mediated by rapid thermocycling; and the like), resulting in the production of partial duplex molecules. The partial duplex molecules, e.g., containing partially extended chains, are then denatured and reannealed in subsequent rounds of replication or partial replication resulting in polynucleotides which share varying degrees of sequence similarity and which are diversified with respect to the starting population of DNA molecules. Optionally, the products, or partial pools of the products, can be amplified at one or more stages in the process. Polynucleotides produced by a chain termination method, such as described above, are suitable substrates for any other described recombination format.

Diversity also can be generated in nucleic acids or populations of nucleic acids using a recombinational procedure termed "incremental truncation for the creation of hybrid enzymes" ("ITCHY") described in Ostermeier et al. (1999) "A combinatorial approach to hybrid enzymes independent of DNA homology" *Nature Biotech* 17:1205. This approach can be used to generate an initial a library of variants which can optionally serve as a substrate for one or more in vitro or in vivo recombination methods. See, also, Ostermeier et al. (1999) "Combinatorial Protein Engineering by Incremental Truncation," *Proc. Natl. Acad. Sci. USA*, 96:3562–67; Ostermeier et al. (1999), "Incremental Truncation as a Strategy in the Engineering of Novel Biocatalysts," *Biological and Medicinal Chemistry,* 7:2139–44.

Mutational methods which result in the alteration of individual nucleotides or groups of contiguous or non-contiguous nucleotides can be favorably employed to introduce nucleotide diversity. Many mutagenesis methods are found in the above-cited references; additional details regarding mutagenesis methods can be found in following, which can also be applied to the present invention. For example, error-prone PCR can be used to generate nucleic acid variants. Using this technique, PCR is performed under conditions where the copying fidelity of the DNA polymerase is low, such that a high rate of point mutations is obtained along the entire length of the PCR product. Examples of such techniques are found in the references above and, e.g., in Leung et al. (1989) *Technique* 1:11–15 and Caldwell et al. (1992) *PCR Methods Applic.* 2:28–33. Similarly, assembly PCR can be used, in a process which involves the assembly of a PCR product from a mixture of small DNA fragments. A large number of different PCR reactions can occur in parallel in the same reaction mixture, with the products of one reaction priming the products of another reaction.

Oligonucleotide directed mutagenesis can be used to introduce site-specific mutations in a nucleic acid sequence of interest. Examples of such techniques are found in the references above and, e.g., in Reidhaar-Olson et al. (1988) *Science,* 241:53–57. Similarly, cassette mutagenesis can be used in a process that replaces a small region of a double stranded DNA molecule with a synthetic oligonucleotide cassette that differs from the native sequence. The oligonucleotide can contain, e.g., completely and/or partially randomized native sequence(s).

Recursive ensemble mutagenesis is a process in which an algorithm for protein mutagenesis is used to produce diverse populations of phenotypically related mutants, members of which differ in amino acid sequence. This method uses a feedback mechanism to monitor successive rounds of combinatorial cassette mutagenesis. Examples of this approach are found in Arkin & Youvan (1992) *Proc. Natl. Acad. Sci. USA* 89:7811–7815. Exponential ensemble mutagenesis can be used for generating combinatorial libraries with a high percentage of unique and functional mutants. Small groups of residues in a sequence of interest are randomized in parallel to identify, at each altered position, amino acids which lead to functional proteins. Examples of such procedures are in Delegrave & Youvan (1993) *Biotechnology Research* 11:1548–1552.

In vivo mutagenesis can be used to generate random mutations in any cloned DNA of interest by propagating the DNA, e.g., in a strain of *E. coli* that carries mutations in one or more of the DNA repair pathways. These "mutator" strains have a higher random mutation rate than that of a wild-type parent. Propagating the DNA in one of these strains will eventually generate random mutations within the DNA. Such procedures are described in the references noted above.

Other procedures for introducing diversity into a genome, e.g. a bacterial, fungal, animal or plant genome can be used in conjunction with the above described and/or referenced methods. For example, in addition to the methods above, techniques have been proposed which produce nucleic acid multimers suitable for transformation into a variety of species (see, e.g., Schellenberger U.S. Pat. No. 5,756,316 and the references above). Transformation of a suitable host with such multimers, consisting of genes that are divergent with respect to one another, (e.g., derived from natural diversity or through application of site directed mutagenesis, error prone PCR, passage through mutagenic bacterial strains, and the like), provides a source of nucleic acid diversity for DNA diversification, e.g., by an in vivo recombination process as indicated above.

Alternatively, a multiplicity of monomeric polynucleotides sharing regions of partial sequence similarity can be transformed into a host species and recombined in vivo by the host cell. Subsequent rounds of cell division can be used to generate libraries, members of which, include a single, homogenous population, or pool of monomeric polynucleotides. Alternatively, the monomeric nucleic acid can be recovered by standard techniques, e.g., PCR and/or cloning, and recombined in any of the recombination formats, including recursive recombination formats, described above.

Methods for generating multispecies expression libraries have been described (in addition to the reference noted above, see, e.g., Peterson et al. (1998) U.S. Pat. No. 5,783,431 "METHODS FOR GENERATING AND SCREENING NOVEL METABOLIC PATHWAYS," and Thompson, et al. (1998) U.S. Pat. No. 5,824,485 METHODS FOR GENERATING AND SCREENING NOVEL METABOLIC PATHWAYS) and their use to identify protein activities of interest has been proposed (In addition to the references noted above, see Short (1999) U.S. Pat. No. 5,958,672 "PROTEIN ACTIVITY SCREENING OF CLONES HAVING DNA FROM UNCULTIVATED MICROORGANISMS"). Multispecies expression libraries include, in general, libraries comprising cDNA or genomic sequences from a plurality of species or strains, operably linked to appropriate regulatory sequences, in an expression cassette. The cDNA and/or genomic sequences are optionally randomly ligated to further enhance diversity. The vector can be a shuttle vector suitable for transformation and expression in more than one species of host organism, e.g., bacterial species, eukaryotic cells. In some cases, the library is biased by preselecting sequences which encode a protein of interest, or which hybridize to a nucleic acid of interest. Any such libraries can be provided as substrates for any of the methods herein described.

The above-described procedures have been largely directed to increasing nucleic acid and/or encoded protein diversity. However, in many cases, not all of the diversity is useful, e.g., functional, and contributes merely to increasing the background of variants that must be screened or selected to identify the few favorable variants. In some applications, it is desirable to preselect or prescreen libraries (e.g., an amplified library, a genomic library, a cDNA library, a normalized library, etc.) or other substrate nucleic acids prior to diversification, e.g., by recombination-based mutagenesis procedures, or to otherwise bias the substrates towards nucleic acids that encode functional products. For example, in the case of antibody engineering, it is possible to bias the diversity generating process toward antibodies with functional antigen binding sites by taking advantage of in vivo recombination events prior to manipulation by any of the described methods. For example, recombined CDRs derived from B cell cDNA libraries can be amplified and assembled into framework regions (e.g., Jirholt et al. (1998) "Exploiting sequence space: shuffling in vivo formed complementarity determining regions into a master framework" *Gene* 215: 471) prior to diversifying according to any of the methods described herein.

Libraries can be biased towards nucleic acids which encode proteins with desirable enzyme activities. For example, after identifying a clone from a library which exhibits a specified activity, the clone can be mutagenized using any known method for introducing DNA alterations. A library comprising the mutagenized homologues is then screened for a desired activity, which can be the same as or different from the initially specified activity. An example of such a procedure is proposed in Short (1999) U.S. Pat. No. 5,939,250 for "PRODUCTION OF ENZYMES HAVING DESIRED ACTIVITIES BY MUTAGENESIS." Desired activities can be identified by any method known in the art. For example, WO 99/10539 proposes that gene libraries can be screened by combining extracts from the gene library with components obtained from metabolically rich cells and identifying combinations which exhibit the desired activity. It has also been proposed (e.g., WO 98/58085) that clones with desired activities can be identified by inserting bioactive substrates into samples of the library, and detecting bioactive fluorescence corresponding to the product of a desired NCSM activity as described herein using a fluorescent analyzer, e.g., a flow cytometry device, a CCD, a fluorometer, or a spectrophotometer.

Libraries can also be biased towards nucleic acids which have specified characteristics, e.g., hybridization to a selected nucleic acid probe. For example, application WO 99/10539 proposes that polynucleotides encoding a desired activity (e.g., an enzymatic activity, for example: a lipase, an esterase, a protease, a glycosidase, a glycosyl transferase, a phosphatase, a kinase, an oxygenase, a peroxidase, a hydrolase, a hydratase, a nitrilase, a transaminase, an amidase or an acylase) can be identified from among genomic DNA sequences in the following manner. Single stranded DNA molecules from a population of genomic DNA are hybridized to a ligand-conjugated probe. The genomic DNA can be derived from either a cultivated or uncultivated microorganism, or from an environmental sample. Alternatively, the genomic DNA can be derived from a multicellular organism, or a tissue derived therefrom. Second strand synthesis can be conducted directly from the hybridization probe used in the capture, with or without prior release from the capture medium or by a wide variety of other strategies known in the art. Alternatively, the isolated single-stranded genomic DNA population can be fragmented without further cloning and used directly in, e.g., a recombination-based approach, that employs a single-stranded template, as described above.

"Non-Stochastic" methods of generating nucleic acids and polypeptides are alleged in Short "Non-Stochastic Generation of Genetic Vaccines and Enzymes" WO 00/46344. These methods, including proposed non-stochastic polynucleotide reassembly and site-saturation mutagenesis methods be applied to the present invention as well. Random or semi-random mutagenesis using doped or degenerate oligonucleotides is also described in, e.g., Arkin and Youvan (1992) "Optimizing nucleotide mixtures to encode specific subsets of amino acids for semi-random mutagenesis" *Bio-technology* 10:297–300; Reidhaar-Olson et al. (1991) "Random mutagenesis of protein sequences using oligonucleotide cassettes" *Methods Enzymol.* 208:564–86; Lim and Sauer (1991) "The role of internal packing interactions in determining the structure and stability of a protein" *J. Mol. Biol.* 219:359–76; Breyer and Sauer (1989) "Mutational analysis of the fine specificity of binding of monoclonal antibody 51F to lambda repressor" *J. Biol. Chem.* 264: 13355–60); and "Walk-Through Mutagenesis" (Crea, R; U.S. Pat. Nos. 5,830,650 and 5,798,208, and EP Patent 0527809 B1.

It will readily be appreciated that any of the above described techniques suitable for enriching a library prior to diversification can also be used to screen the products, or libraries of products, produced by the diversity generating methods.

Kits for mutagenesis, library construction and other diversity generation methods are also commercially available. For example, kits are available from, e.g., Stratagene (e.g., QuickChange™ site-directed mutagenesis kit; and Chameleon™ double-stranded, site-directed mutagenesis kit), Bio/Can Scientific, Bio-Rad (e.g., using the Kunkel method described above), Boehringer Mannheim Corp., Clonetech Laboratories, DNA Technologies, Epicentre Technologies (e.g., 5 prime 3 prime kit); Genpak Inc, Lemargo Inc, Life Technologies (Gibco BRL), New England Biolabs, Pharmacia Biotech, Promega Corp., Quantum Biotechnologies, Amersham International plc (e.g., using the Eckstein method above), and Anglian Biotechnology Ltd (e.g., using the Carter/Winter method above).

The above references provide many mutational formats, including recombination, recursive recombination, recursive mutation and combinations or recombination with other forms of mutagenesis, as well as many modifications of these formats. Regardless of the diversity generation format that is used, the nucleic acids of the invention can be recombined (with each other, or with related (or even unrelated) sequences) to produce a diverse set of recombinant nucleic acids, including, e.g., sets of homologous nucleic acids, as well as corresponding polypeptides.

A recombinant nucleic acid produced by recombining one or more polynucleotide sequences of the invention with one or more additional nucleic acids using any of the above-described formats alone or in combination also forms a part of the invention. The one or more additional nucleic acids may include another polynucleotide of the invention; optionally, alternatively, or in addition, the one or more additional nucleic acid can include, e.g., a nucleic acid encoding a naturally-occurring B7-1, co-stimulatory homologue or a subsequence thereof, or any homologous B7-1, co-stimulatory sequence or subsequence thereof (e.g., as found in GenBank or other available literature), or, e.g., any other homologous or non-homologous nucleic acid or fragments thereof (certain recombination formats noted above, notably those performed synthetically or in silico, do not require homology for recombination).

Polypeptides of the Invention

The invention provides isolated or recombinant NCSM polypeptides, fragments thereof, and homologues, variants and derivatives thereof, collectively referred to herein as "NCSM polypeptides" or "NCSM polypeptide" unless otherwise specifically noted. The term "NCSM polypeptide" is intended throughout to include amino acid fragments, homologues, derivatives, variants of the polypeptide and protein sequences specifically disclosed herein unless otherwise noted. Polypeptide variants include those with conservative amino acid substations ("conservatively substituted variations") as described above. Also included in this invention are fusion proteins comprising NCSM polypeptides and proteins, chimeric NCSM polypeptides, comprising one or more fragments from one or more NCSM polypeptides set forth herein.

As discussed above, the invention provides CD28BP polypeptides and CTLA-4BP polypeptides and fragments of either thereof that bind either or both of CD28 or CTLA-4 receptor. In some embodiments, a CD28BP polypeptide of the invention (including fragments thereof, such as soluble ECDs and fusion proteins) has a binding affinity for CD28 that is about equal to or greater than that of hB7-1 for CD28 (which is about $4\times10^{-6}$M) and/or a binding affinity for CTLA-4 that is about equal to or less than that of hB7-1 for CTLA-4 (i.e., about $0.2$–$0.4\times10^{-6}$ M). In other embodiments, a CD28BP of the invention has a CD28/CTLA-4 binding affinity ratio that is equal to or greater than that of hB7-1. In some such embodiments, a ratio of specific binding affinities CD28/CTLA-4 for a CD28BP is at least about $0.5$–$1\times10^{-1}$.

In other embodiments, a CTLA-4BP polypeptide of the invention (including fragments thereof, such as soluble ECDs and fusion proteins) has a CTLA-4/CD28 binding affinity ratio that is equal to or greater than that of hB7-1. In some embodiments, a CTLA-4BP polypeptide of the invention has a binding affinity for CTLA-4 that is about equal to or greater than that of hB7-1 for CTLA-4 (i.e., about $4\times10^{-6}$ M) and/or a binding affinity for CD28 that is about equal to or less than that of hB7-1 for CD28 (which ranges from about $0.2\times10^{-6}$ M to about $0.4\times10^{-6}$ M). In other embodiments, a CTLA-4BP has a binding affinity for CTLA-4 and CD28 that is less than the binding affinity of hB7-1 for either receptor; however, the ratio of these binding affinities ratio (CTLA-4/CD28) is still at least equal to or greater than that of hB7-1. In other embodiments, for a CTLA-4BP, a ratio of specific binding affinities CTLA-4/CD28 is at least about 10.

CD28BP Polypeptides

In one aspect, the invention provide an isolated or recombinant CD28BP polypeptides comprising an extracellular domain (ECD) sequence, wherein the ECD sequence has at least about 65%, 70% 75%, 80%, 85%, 90%, 91%, 92%, 93%, 94%, 95%, 96%, 97%, 98%, 99%, or 99.5% or more amino acid sequence identity to an extracellular domain sequence of at least one of SEQ ID NOS:48–68, 174–221, 283–285, and 290–293, and is not a naturally-occurring extracellular domain sequence, and wherein said polypeptide has a CD28/CTLA-4 binding affinity ratio equal to or greater than the CD28/CTLA-4 binding affinity ratio of human B7-1.

For some such polypeptides, the polypeptide comprises an extracellular domain amino acid sequence or the full-length amino acid sequence of any one of SEQ ID NOS: 48–68, 174–182, 184–221, 283–285, and 290–293. Some such polypeptides comprise an extracellular domain sequence of any one of SEQ ID NOS:48–68 and 174–209. For some such polypeptides, the polypeptide comprises an extracellular domain sequence encoded by a coding polynucleotide sequence that is selected from the group of: (a) an ECD coding sequence of a polynucleotide sequence selected from any of SEQ ID NOS:1–21 and 95–142; (b) an polynucleotide sequence that encodes the ECD of a polypeptide selected from any of SEQ ID NOS:48–68, 174–221, 283–285, and 290–293; and (c) a polynucleotide sequence which hybridizes under stringent conditions over substantially the entire length of a polynucleotide sequence (a) or (b).

Some such CD28BP polypeptides described above have an equal or enhanced binding affinity for CD28 as compared to a binding affinity of a WT co-stimulatory molecule for CD28. Some such polypeptides have a CD28/CTLA-4 binding affinity ratio at least equal to or greater than the CD28/CTLA-4 binding affinity ratio of hB7-1. In one aspect, some such polypeptides have a decreased or a lowered binding affinity for CTLA-4 as compared to a binding affinity of a wild type co-stimulatory molecule for CTLA-4. Some such CD28BP polypeptides may induce T-cell proliferation or T-cell activation or both T-cell proliferation and T-cell activation, such as, e.g., in association with co-stimulation of T cell receptor/CD3 (by, e.g., an antigen or antiCD3 antibody). The induced T-cell proliferative response may be equal to or greater than that of human B7-1 for some such polypeptides. In another aspect, some such polypeptides described above modulate T-cell activation, but do not induce proliferation of purified T-cells activated by soluble anti-CD3 mAbs.

In another aspect, the invention provides isolated or recombinant CD28BP polypeptides that comprise a non-naturally-occurring amino acid sequence encoded by a nucleic acid comprising a polynucleotide sequence selected from the group of: (a) a polynucleotide sequence selected from SEQ ID NOS:1–21 and 95–142, or a complementary polynucleotide sequence thereof; (b) a polynucleotide sequence encoding a polypeptide selected from SEQ ID NOS:48–68, 174–221, 283–285, and 290–293, or a complementary polynucleotide sequence thereof; (c) a polynucleotide sequence which hybridizes under highly stringent conditions over substantially the entire length of polynucleotide sequence (a) or (b); (d) a polynucleotide sequence comprising all or a fragment of (a), (b), or (c), wherein the fragment encodes a polypeptide having a CD28/CTLA-4 binding affinity ratio equal to or greater than the CD28/CTLA-4 binding affinity ratio of human B7-1; (e) a polynucleotide sequence encoding a polypeptide, the polypeptide comprising an amino acid sequence which is substantially identical over at least about 150 contiguous amino acid residues of any one of SEQ ID NOS:48–68, 174–221, 283–285, and 290–293; and (f) a polynucleotide sequence encoding a polypeptide that has a CD28/CTLA-4 binding affinity ratio equal to or greater than the CD28/CTLA-4 binding affinity ratio of human B7-1, which polynucleotide sequence has at least about 65%, 70%, 75%, 80%, 85%, 90%, 91%, 92%, 93%, 94%, 95%, 96%, 97%, 98%, 99%, or more identity to at least one polynucleotide sequence of (a), (b), (c), or (d). In one aspect, such CD28BP polypeptides comprise the full-length amino acid sequence of any one of SEQ ID NOS:48–68, 174–221, 283–285, and 290–293.

The above-described polypeptides have a CD28/CTLA-4 binding affinity ratio equal to or greater than the CD28/CTLA-4 binding affinity ratio of human B7-1. Some such polypeptides induce a T-cell proliferation in association with TCR stimulation; the response may be equal to or greater than that of human B7-1.

In yet another embodiment, the invention provides isolated or recombinant polypeptides comprising a sequence according to the formula:

MGHTM-X6-W-X8-SLPPK-X14-PCL-X18-X19-X20-QLLVLT-X27-LFYFCSGITPKSVTKRVKETVMLSCDY-X55-TSTE-X60-LTSLRIYW-X69-KDSKMV-LAILPGKVQVWPEYKNRTITDMNDN-X101-RIVI-

X106-ALR-X110-SD-X113-GTYTCV-X120-QKP-X124-LKGAYKLEHL-X135-SVRLMIRADFPVP-X149-X150-X151-DLGNPSPNIRRLICS-X167-X168-X169-GFPRPHL-X177-WLENGEELNATNTT-X192-SQDP-X197-T-X199-LYMISSEL-X208-FNVTNN-X215-SI-X218-CLIKYGEL-X227-VSQIFPWSKPKQEPPIDQLPF-X249-VIIPVSGALVL-X261-A-X263-VLY-X267-X268-ACRH-X273-ARWKRTRRNEETVGTE RLSPIYLGSAQSSG (SEQ ID NO:284), or a subsequence thereof comprising the extracellular domain, wherein position X6 is Lys or Glu; position X8 is Arg or Gly; position X14 is Arg or Cys; position X18 is Trp or Arg; position X19 is Pro or Leu; position X20 is Ser or Pro; position X27 is Asp or Gly; position X55 is Asn or Ser; position X60 is Glu or Lys; position X69 is Gln or Arg; position X101 is Pro or Leu; position X106 is Leu or Gln; position X110 is Pro or Leu; position X113 is Lys or Ser; position X120 is Val or Ile; position X124 is Val or Asp; position X135 is Thr or Ala; position X149 is Thr, Ser, or del; position X150 is Ile or del; position X151 is Asn or Thr; position X167 is Thr or del; position X169 is Ser or del; position X169 is Gly or del; position X177 is Cys or Tyr; position X192 is Val or Leu; position X197 is Gly or Glu; position X199 is Glu or Lys; position X208 is Gly or Asp; position X215 is His or Arg; position X218 is Ala or Val; position X227 is Ser or Leu; position X249 is Trp, Leu, or Arg; position X261 is Ala or Thr; position X263 is Val, Ala, or Ile; position X267 is Arg or Cys; position X268 is Pro or Leu; and position X273 is Gly or Val. Some such polypeptides have one or more of the properties of CD28 polypeptides described herein, including an ability to enhance an immune response, induce a T cell activation or proliferation response, exhibit a CD28/CTLA-4 binding affinity ratio equal to or greater than that of hB7-1, and/or alter cytokine production. For some such polypeptides, the induced T cell response is equal to or greater than that of hB7-1. In one embodiment, some such polypeptides comprise an extracellular domain sequence of any one of SEQ ID NOS:51–56, 58, 61, 66, 67, 174–179, 181, 185–187, 189, 192–194, 197, 199, 202, 205, 208, 215, 217, 220, and 285.

In another embodiment, some such polypeptides comprise two, three, four, five, six, eight, ten, or more of: Lys at position X6; Arg at position X8; Arg at position X14; Trp at position X18; Pro at position X19; Ser at position X20; Asp at position X27; Asn at position X55; Leu at position X106; Pro at position X110; Lys at position X113; Val at position X120; Val at position X124; Thr at position X135; Asn at position X151; Cys at position X177; Val at position X192; Gly at position X197; Glu at position X199; Gly at position X208; His at position X215; Ala at position X218; Trp at position X249; Ala at position X261; Val at position X263; Arg at position X267; Pro at position X268; and Gly at position X273. In a preferred embodiment, some such polypeptides comprise two, three, four, five, six, eight, ten, or more of: Arg at position X8; Arg at position X14; Trp at position X18; Pro at position X19; Ser at position X20; Pro at position X110; Val at position X120; Val at position X124; Cys at position X177; Val at position X192; Gly at position X197; Glu at position X199; Gly at position X208; His at position X215; Ala at position X218; Trp at position X249; Ala at position X261; and Val at position X263. In yet another preferred embodiment, some such polypeptides comprise the extracellular domain sequence of SEQ ID NO:66 or SEQ ID NO:285. In yet another preferred embodiment, some such polypeptides comprise the sequence of SEQ ID NO:66 or SEQ ID NO:285.

In another aspect, the invention provides isolated or recombinant CD28BP polypeptides comprising a subsequence of an amino acid sequence set forth in any of SEQ ID NOS:48–68, 174–182, 184–221, 283–285, and 290–293, wherein the subsequence is the extracellular domain of said amino acid sequence.

The invention also provides isolated or recombinant polypeptides comprising a sequence according to the formula:

MGHTMKWGSLPPKRPCLWLSQLLVLT-GLFYFCSGITPK SVTKRVKETVM-X50-SCDY-X55-X56-STEELTSLRIYWQKDSKMVL AILPGKVQVW-PEYKNRTITD MNDNPRIVILALRLSD-X113-GTYTCV-X120-QK-X123-X124-X125-X126-G-X128-X129-X130-X131-EHL-X135-SV-X138-L-X140-IRADFPVPSITDIGHPAPNVK RIRCSASG-X170-FPEPRLAWMEDGEEL NAVNTTV-X193-X194-X195-LDTELYSVSSELD-X209-N-X211-TNNHSIVCLIKYGELSVSQIFPWSKPK QEPPIDQLPFWVI-X252-X253-VSGALVLTAVVLYCLA-CRHVAR (SEQ ID NO:290), or subsequence thereof comprising the extracellular domain, wherein position X50 is Leu or Pro; position X55 is Asn or Ser; position X56 is Ala or Thr; position X113 is Ser or Lys; position X120 is Ile or Val; position X123 is Pro or deleted; position X124 is Val, Asn, or Asp; position X125 is Leu or Glu; position X126 is Lys or Asn; position X128 is Ala or Ser; position X129 is Tyr or Phe; position X130 is Lys or Arg; position X131 is Leu or Arg; position X135 is Ala or Thr; position X138 is Arg or Thr; position X140 is Met or Ser; position X170 is Asp or Gly; position X193 is Asp or is deleted; position X194 is Gln or is deleted; position X195 is Asp or is deleted; position X211 is Val or Ala; position X252 is Ile or Val; and position X253 is Leu or Pro. Some such polypeptides have at least one of the properties of CD28 polypeptides described herein, including an ability to enhance an immune response, induce T cell activation or proliferation, exhibit a CD28/CTLA-4 binding affinity ratio equal to or greater than that of hB7-1, and/or alter cytokine production. For some such polypeptides, the induced T cell response is equal to or greater than that of hB7-1.

In a preferred embodiment, some such CD28BP polypeptides comprise two, three, four, five, six, eight, ten, or more of: Leu at position X50; Asn at position X55; Ala at position X56; Ser at position X113; Ile at position X120; Pro at position X123; Val at position X124; Leu at position X125; Lys at position X26; Ala at position X128; Tyr at position X129; Lys at position X130; Leu at position X131; Ala at position X135; Arg at position X138; Met at position X140; Asp at position X170; Asp at position X193; Asp at position X194; Asp at position X195; Val at position X211; Ile at position X252; and Leu at position X253. In yet another preferred embodiment, some such polypeptides comprise a sequence of any one of SEQ ID NOS:59, 62, 180, 184, 188, 195, 196, 200, 201, 204, 211, 213, 219, and 291.

In another aspect, the invention provides isolated or recombinant polypeptides comprising a sequence according to the formula:

MGHTMKWG-X9-LPPKRPCLWLSQLLVLTGLFY-FCSG-X35-TPKSVTKRV KETVMLSCDY-X55-TSTEELTSLRIYWQKDSKMVLAILPGKVQVW PEYKNRTITDMNDNPRIVILALR-X110-SDSG-TYTCVIQKP-X124-LKGAYKLEHL-X135-SVR-LMIRADFPVPTINDLGNPSPNIR-RLICSTSGGFPRPHLYWLENG-X183-ELNATNTT-X192-SQDPETKLYMISSELDFN-X211-TSN-X215-X216-X217-LCLVKYGDLTVSQ-X231-

FYWQESKPTPSANQHLTWTIIIPVSAFGISVIIAVI LTCLTCRNAAIRRQRRENEV-X288-M-X290-SCSQSP (SEQ ID NO:292), or a subsequence thereof comprising the extracellular domain, wherein position X9 is Thr or Ser; position X35 is Ile or Thr; position X55 is Asn or Ser; position X110 is Leu or Pro; position X124 is Asp or Val; position X135 is Thr or Ala; position X183 is Lys or Glu; position X192 is Leu or Val; position X211 is Met or Thr; position X215 is His or is deleted; position X216 is Ser or is deleted; position X217 is Phe or is deleted; position X231 is Thr or Ser; position X288 is Lys or Glu; position X290 is Glu or Gln, and wherein said sequence is a non naturally-occurring sequence. Further, some such polypeptides have at least one of the properties of CD28 polypeptides described herein, including an ability to enhance an immune response, induce T cell activation or proliferation, exhibit a CD28/CTLA-4 binding affinity ratio equal to or greater than that of hB7-1, and/or alter cytokine production. For some such polypeptides, the induced T cell response is equal to or greater than that of hB7-1.

In a preferred embodiment, some such polypeptides comprise two, three, four, five, six, eight, ten, or more of the following amino acids: Thr at position X9; Ile at position X35; Asn at position X55; Leu at position X110; Asp at position X124; Thr at position X135; Lys at position X183; Leu at position X192; Met at position X211; His at position X215; Ser at position X216; Phe at position X217; Thr at position X231; Lys at position X288; and Glu at position X290. In yet another preferred embodiment, some such polypeptides comprise a sequence of any one of SEQ ID NOS:48, 182, 183, 212, 214, 216, 218, 221, and 293.

CTLA-4BP Polypeptides

In one aspect, the invention provides isolated or recombinant CTLA-4BP polypeptides each comprising a sequence having at least about 85%, 88%, 89%, 90%, 91%, 92&, 93%, 94%, 95%, 96%, 97%, 98%, 99%, 99.5% or more percent identity to at least one of SEQ ID NOS:69–92, 222–252, 286–289, or a subsequence thereof comprising the extracellular domain, wherein said sequence (a) is a non naturally-occurring sequence, and (b) comprises at least one of: Gly at position 2; Thr at position 4; Arg at position 5; Gly at position 8; Pro at position 12; Met at position 25; Cys at position 27; Pro at position 29; Leu at position 31; Arg at position 40; Leu at position 52; His at position 65; Ser at position 78; Asp at position 80; Tyr at position 87; Lys at position 120; Asp at position 122; Lys at position 129; Met at position 135; Phe at position 150; Ile at position 160; Ala at position 164; His at position 172; Phe at position 174; Leu at position 176; Asn at position 178; Asn at position 186; Glu at position 194; Gly at position 196; Thr at position 199; Ala at position 210; His at position 212; Arg at position 219; Pro at position 234; Asn at position 241; Leu at position 244; Thr at position 250; Ala at position 254; Tyr at position 265; Arg at position 266; Glu at position 273; Lys at position 275; Ser at position 276; an amino acid deletion at position 276; or Thr at position 279, wherein the position number corresponds to that of hB7-1 amino acid sequence (SEQ ID NO:278), wherein said polypeptide has a CTLA-4/CD28 binding affinity ratio equal to or greater than a CTLA-4/CD28 binding affinity ratio of hB7-1.

Such CTLA-4BP polypeptides described above have an altered binding affinity for CTLA-4 and/or CD28 as compared to the binding affinity of a WT co-stimulatory molecule for CD28 or CTLA-4. Some such polypeptides have a CTLA-4/CD28 binding affinity ratio equal to or greater than that of hB7-1. In one aspect, some such polypeptides have a decreased binding affinity for CD28 or CTLA-4 as compared to a binding affinity of a hB7-1 to CD28 or CTLA-4, respectively. Such polypeptides may inhibit at least one or T-cell proliferation or activation in association with co-stimulation of TCR/CD3 (by, e.g., an antigen or antiCD3 antibody). The induced T-cell proliferative response may be less than that of hB7-1 for some such polypeptides. In another aspect, some such polypeptides described above modulate T-cell activation, but do not induce proliferation of purified T-cells activated by soluble anti-CD3 mAbs.

Some such CTLA-4BP polypeptides each comprise a sequence having at least about 98% identity to at least one of SEQ ID NOS:69–92, 222–252, and 286–289, said sequence comprising at least one of: Gly at position 2; Gly at position 8; Cys at position 27; His at position 65; Asp at position 80; Asp at position 122; Met at position 135; Phe at position 150; Ala at position 164; Phe at position 174; Asn at position 186; Glu at position 194; Arg at position 219; Thr at position 250; Arg at position 266; Lys at position 275; and Ser at position 276, wherein amino acid position numbers correspond to that of the hB7-1 amino acid sequence (SEQ ID NO:278). In one aspect, such polypeptides may comprise the ECD or full-length amino acid sequence of any one of SEQ ID NOS:69–92, 222–252, and 286–289.

In a preferred embodiment, some such above-described CTLA-4BP polypeptides comprise a sequence having at least about 98% identity to the extracellular domain of at least one of SEQ ID NOS:69–92, 222–252, and 286–289, said sequence comprising at least one of: His at position 65; Asp at position 80; Asp at position 122; Met at position 135; Phe at position 150; Ala at position 164; Phe at position 174; Asn at position 186; Glu at position 194; and Arg at position 219, wherein the amino acid position numbers correspond to that of hB7-1 amino acid sequence (SEQ ID NO:278).

Further, some such polypeptides comprise a sequence having at least about 98% identity to the ECD of at least one of SEQ ID NOS:69–92, 222–252, 286–289, said sequence comprising at least two, three, four, five, six or more of: His at position 65; Asp at position 80; Asp at position 122; Met at position 135; Phe at position 150; Ala at position 164; Phe at position 174; Asn at position 186; Glu at position 194; and Arg at position 219, wherein the amino acid position numbers correspond to that of h B7-1 amino acid sequence (SEQ ID NO:278). Some such CTLA-4BP polypeptides comprise an ECD amino acid sequence of any one of SEQ ID NOS:69–92 and 222–247. In a preferred embodiment, such CTLA-4BP polypeptides comprise an ECD sequence of any one of SEQ ID NOS:81, 85, 86, 88, 90, and 91.

In another aspect, some such above-described CTLA-4BP polypeptides comprises an ECD domain sequence encoded by a coding polynucleotide sequence, the coding polynucleotide sequence selected from the group: (a) an ECD coding sequence of a polynucleotide sequence selected from any of SEQ ID NOS:22–45 and 143–173; (b) a polynucleotide sequence that encodes the ECD amino acid sequence of a polypeptide selected from any of SEQ ID NOS:69–92, 222–252, and 286–289; and (c) a polynucleotide sequence which hybridizes under stringent conditions over substantially the entire length of a polynucleotide sequence (a) or (b).

The invention also provides isolated or recombinant polypeptides each comprising a sequence that differs from a primate B7-1 sequence in at least one mutation selected from: Ser 12 Pro; Leu 25 Met; Gly 27 Cys; Ser 29 Pro; Lys 40 Arg; His 52 Leu; Tyr 65 His; Glu 122 Asp; Glu 129 Lys; Thr 135 Met; Thr 164 Ala; Ser 174 Phe; Glu 196 Gly; Ala 199 Thr; Thr 210 Ala; Lys 219 Arg; Thr 234 Pro; Asp 241

Asn; Val 254 Ala; Arg 275 Lys; Arg 276 Ser; or Arg 279 Thr. The mutation being indicated is relative to human B7-1 with the amino acid sequence shown in SEQ ID NO:278, the sequence does not occur in nature, and the polypeptide has a CTLA-4/CD28 binding affinity ratio equal to or greater than the CTLA-4/CD28 binding affinity ratio of human B7-1. The sequence of some such polypeptides differs from primate B7-1 sequence in at least two of said mutations. In some aspects, the primate B7-1 is hB7-1 (SEQ ID NO:278), and in some aspects, the sequence differs from the hB7-1 sequence in at least two mutations.

In another aspect, the invention provides isolated or recombinant CTLA-4BP polypeptides comprising a sequence having at least about 75%, 80%, 85%, 90%, 95%, or more percent identity to at least one of SEQ ID NOS: 263–272, or a subsequence thereof comprising the ECD, wherein the sequence is not a naturally-occurring sequence, and the polypeptide has a CTLA-4/CD28 binding affinity ratio equal to or greater than the CTLA-4/CD28 binding affinity ratio of hB7-1.

In yet another aspect, the invention provides isolated or recombinant polypeptides that each comprise a non naturally-occurring amino acid sequence encoded by a nucleic acid comprising a polynucleotide sequence selected from: (a) a polynucleotide sequence selected from SEQ ID NOS: 22–45, 143–173, 253–262, or a complementary polynucleotide sequence thereof; (b) a polynucleotide sequence encoding a polypeptide selected from SEQ ID NOS:69–92, 222–247, 263–272, 286–289, or a complementary polynucleotide sequence thereof; (c) a polynucleotide sequence which hybridizes under at least stringent or highly stringent conditions over substantially the entire length of polynucleotide sequence (a) or (b); (d) a polynucleotide sequence comprising all or a fragment of (a), (b), or (c), wherein the fragment encodes a polypeptide having a CTLA-4/CD28 binding affinity ratio equal to or greater than that of hB7-1; (e) a polynucleotide sequence encoding a polypeptide, the polypeptide comprising an amino acid sequence which is substantially identical over at least about 150, 180, 200, 225, 250 or more contiguous amino acid residues of any one of SEQ ID NOS:69–92, 222–247, 263–272, 286–289, and (f) a polynucleotide sequence encoding a polypeptide that has a CTLA-4/CD28 binding affinity ratio equal to or greater than that of hB7-1, which polynucleotide sequence has at least about 70%, 80%, 85%, 90%, 93%, 95%, 96%, 97%, 98%, 99%, or more identity to at least one polynucleotide sequence of (a), (b), (c), or (d). Some such polypeptides comprise an amino acid sequence of any one of SEQ ID NOS:69–92, 222–247, 263–272, and 286–289.

Such above-described polypeptides have a CTLA-4/CD28 binding affinity ratio equal to or greater than the CTLA-4/CD28 binding affinity ratio of human B7-1. Some such polypeptides inhibit T-cell proliferation. The induced T-cell response may be less than that of human B7-1.

In yet another aspect, the invention includes isolated or recombinant polypeptides that each comprise a sequence according to the formula:

MGHTRRQGTSP-X12-KCPYLKFFQLLV-X25-ACL-X29-HLCSGVIHVT-X40-EVKEVATLSCGLNVS-VEELAQTRIHWQKEKKMVLTM MSGDMNIW-PEYKNRTIFDITNNLSIVILALRPSDEGTYECVVLKY-X122-KDAFKR-X129-HLAEVMLSVKAD FPTPSITDFEIPPSNIRRIICS-X164-SGGFPEPHLF-WLENGEELNAINTTVSQDPET-X196-LYTVSSKLD-FNM TANHSFMCLI-X219-YGHLRVNQTFNWNTP-KQEHFP-X241-NLLPSWA ITLISANGIFVICCLTYRFAPRCRERKS-NETLRRESVCPV (SEQ ID NO:287), or a subsequence thereof comprising the extracellular domain, wherein position X12 is Ser or Pro; position X25 is Leu or Met; position X29 is Ser or Pro; position X40 is Lys or Arg; position X122 is Glu or Asp; position X129 is Glu or Lys; position X164 is Thr or Ala; position X196 is Glu or Gly; position X219 is Lys or Arg; and position X241 is Asp or Asn. In a preferred embodiment, some such polypeptides comprise the ECD of SEQ ID NO:288 or SEQ ID NO:289. In another preferred embodiment, some such polypeptides comprise the amino acid sequence SEQ ID NO:288 or SEQ ID NO:289. In one aspect, such polypeptides exhibit at least one of the CTLA-4BP properties described above, including a CTLA-4/CD28 binding affinity ratio equal to or greater than the CTLA-4/CD28 binding affinity ratio of human B7-1. Some such polypeptides inhibit T-cell proliferation; for some polypeptides, the induced T-cell response is less than that induced by hB7-1 in the presence of e.g., antiCD3 Abs or antigen.

The invention also provides isolated or recombinant polypeptides that each comprise a subsequence of an amino acid sequence set forth in any of SEQ ID NOS:69–92, 222–247, 263–272, and 286–289, wherein the subsequence is the ECD of the amino acid sequence.

In addition, the invention provides novel isolated or recombinant polypeptides corresponding to baboon and orangutan B7-1. Such polypeptides comprise the sequence SEQ ID NO:93 or SEQ ID NO:94, or a subsequence thereof, wherein the subsequence comprises at least one of: the signal sequence, extracellular domain, transmembrane domain, and the cytoplasmic domain of the polypeptide.

Additional Aspects

Any isolated or recombinant CD28BP or CTLA-4 polypeptide described above may further comprise at least one of the following components: a signal sequence, transmembrane domain, or cytoplasmic domain. Various combinations of such from the various NCSM polypeptide sequences described herein can be made. In one aspect, a signal sequence, transmembrane domain or cytoplasmic domain signal sequence is selected from the signal sequence, transmembrane domain, or cytoplasmic domain, respectively, set forth in any of SEQ ID NOS:48–94, 174–252, 263–272, and 283–293.

Any isolated or recombinant CD28BP or CTLA-4BP polypeptide described above may comprise a soluble extracellular domain of the respective full-length CD28BP or CTLA-4BP polypeptide or a fragment (e.g., truncated ECD) or subsequence thereof. Any such CD28BP or CTLA-4BP polypeptide may comprise a fusion protein comprising a CD28BP-ECD or CTLA-4BP-ECD or fragment thereof and at least one additional amino acid sequence, which may comprise an Ig polypeptide. The Ig polypeptide may be a human IgG polypeptide comprising an Fc hinge, a CH2 domain, and a CH3 domain.

Any isolated or recombinant CD28BP or CTLA-4BP polypeptide described above may also comprise a polypeptide purification subsequence. The polypeptide purification subsequence is selected from, e.g., an epitope tag, a FLAG tag, a polyhistidine sequence, and a GST fusion.

In addition, isolated or recombinant CD28BP or CTLA-4BP polypeptide described above may comprise a modified amino acid. The modified amino acid can be, e.g., a glycosylated amino acid, a PEGylated amino acid, a farnesylated amino acid, an acetylated amino acid, a biotinylated amino acid, an amino acid conjugated to a lipid moiety, and an amino acid conjugated to an organic derivatizing agent.

The invention also provides a composition comprising at least one polypeptide of any CD28BP and/or CTLA-4BP polypeptide described above and an excipient or carrier. In one aspect, the composition comprises an isolated or recombinant NCSM polypeptide comprising the amino acid sequence SEQ ID NOS:48–94, 174–252, 263–272, and 283–293, or a fragment thereof and a carrier or excipient. The CD28BP fragment has a CD28/CTLA-4 binding affinity ratio equal to or greater than the CD28/CTLA-4 binding affinity ratio of human B7-1. The CTLA-4BP fragment has a CTLA-4/CD28 binding affinity ratio equal to or greater than that of h7-1. The composition may be a pharmaceutical composition including a pharmaceutically acceptable excipient or carrier. Exemplary and preferred compositions and pharmaceutically acceptable excipients and carriers are described below.

Consensus Sequences and Subsequences

The present invention also includes at least one NCSM polypeptide consensus sequence derived from a comparison of two or more NCSM polypeptide sequences described herein. For example, the present invention includes at least one CD28BP or CTLA-4BP polypeptide consensus sequences derived from a comparison of, respectively, two or more CD28BP or CTLA-4BP polypeptide sequences described herein. A CD28BP polypeptide consensus sequence as used herein refers to a nonnaturally-occurring or recombinant polypeptide that predominantly includes those amino acid residues that are common to all CD28BP polypeptides of the present invention described herein (e.g., full-length and ECD polypeptides and fragments having activities described herein) and that includes, at one or more of those positions wherein there is no amino acid common to all subtypes, an amino acid that predominantly occurs at that position and in no event includes any amino acid residue that is not extant in that position in at least one CD28BP of the invention. A CD28BP polypeptide consensus sequence may have at least one property of a CD28BP polypeptide as described herein (e.g., CD28/CTLA-4 binding affinity ratio at least equal to greater than that of hB7-1; ability to enhance an immune response, stimulate T cell proliferation or activation).

A CTLA-4BP polypeptide consensus sequence refers to a nonnaturally-occurring or recombinant polypeptide that predominantly includes those amino acid residues which are common to all CTLA-4BP polypeptides of the present invention (e.g., full-length and ECD polypeptides) and that includes, at one or more of those positions wherein there is no amino acid common to all subtypes, an amino acid that predominantly occurs at that position and in no event includes any amino acid residue that is not extant in that position in at least one CTLA-4BP of the invention. A CTLA-4BP polypeptide consensus may have at least one property of a CTLA-4BP polypeptide as described herein (e.g., CTLA-4/CD28 binding affinity ratio at least equal to greater than that of hB7-1; suppress an immune response, or inhibit T cell proliferation or activation).

An alignment of the amino acid sequence of the full-length parental WT hB7-1 with each R1 and R2 CD28BP amino acid sequence is shown in FIGS. 2A–2H. An alignment of the amino acid sequence of the full-length parental WT hB7-1 with each R1 and R2 CTLA-4BP amino acid sequence is shown in FIGS. 3A–3H. Both figures also show the regions of hB7-1 corresponding to the signal peptide, ECD, transmembrane domain, cytoplasmic domain, and mature region (see arrows).) As shown, a number of the CD28BP and CTLA-4BP sequences include two additional amino acid residues in the putative signal sequence, as shown by comparison of these recombinant (chimeric) NCSMs with hB7-1; thus, the ECD for these sequences putatively begins at amino acid residue 37. Of the 7 parental species used for recursive sequence recombination, only the bovine amino acid sequence includes two additional amino acid residues in the putative signal peptide sequence.

In one aspect, the invention provides the CD28BP consensus polypeptide sequence (SEQ ID NO:283) and the CTLA-4BP consensus polypeptide sequence (SEQ ID NO:286) and respective fragments or subsequences thereof that have at least one property of a CD28BP or CTLA-4BP polypeptide as described herein. A subsequence of a CD28BP or CTLA-4BP consensus sequence includes a sequence that substantially corresponds (via visual inspection of alignment) to each of the ECD, transmembrane domain, cytoplasmic domain, signal peptide, or mature region of any respective CD28BP or CTLA-4BP polypeptide shown in the alignment in FIGS. 2A–2H and 3A–3H.

The present invention also includes fragments and subsequences of the other CD28BP and CTLA-4BP amino acid sequences shown in FIGS. 2A–2H and 3A–H, respectively, and nucleic acids encoding such fragments and subsequences. Some such CD28BP and CTLA-4BP amino acid fragments and subsequences have at least one property similar or equivalent (or improved upon) to a CD28BP or CTLA-4BP polypeptide, respectively, as described above.

In particular, the invention includes amino acid fragments or subsequences of the CD28BP or CTLA-4BP shown in FIGS. 2A–2H and 3A–H, respectively, and nucleic acid sequences encoding such fragments and subsequences, wherein said fragments or subsequences comprise at least one of the mature domain, ECD, transmembrane domain, signal peptide, and/or cytoplasmic domain of the CD28BP or CTLA-4BP sequences shown in FIGS. 2A–2H and 3A–H. These domains may be identified by functional analysis, expression pattern, or comparison by amino acid (or nucleic acid) alignment with a corresponding domain of a WT B7-1 sequence.

For example, a hB7-1 polypeptide (or polynucleotide) sequence is aligned with a fragment or subsequence of the invention, with amino acid (or nucleic acid) residues being aligned at equivalent positions. The numbering of amino acid residues (or nucleic acid residues) in a particular domain, such as the ECD, for a CD28BP or CTLA-4BP fragment or subsequence is based upon the numbering of residues in the corresponding CD28BP or CTLA-4BP polypeptide (or polynucleotide) sequence or, if desired, upon the amino acid numbering in a parental or WT B7-1 polypeptide (or polynucleotide) sequence, such as hB7-1. The amino acids comprising a signal sequence, ECD, mature domain, transmembrane domain, or cytoplasmic domain of a C28BP or CTLA-4BP polypeptide of the invention, or polynucleotide encoding same, can be determined by alignment with a corresponding region of a WT B7-1 (e.g., hB7-1) polypeptide, or polynucleotide encoding the same; positions equivalent to those for the WT B7-1 (FIGS. 2A–2H and 3A–3H) can be determined.

The invention also provides at least one fragment of an isolated or recombinant CD28BP polypeptide sequence selected from at least one of SEQ ID NOS:48–68, 174–221, 283–285, and 289–293, wherein the fragment binds or specifically binds with a CD28 and/or CTLA4 receptor and/or induces T cell proliferation or activation in conjunction with stimulation of a T cell receptor (e.g., by antigen) as described herein for CD28BP polypeptides, and provided the fragment itself is not an amino acid fragment known in the art to have such properties.

In addition, the invention provides at least one fragment of an isolated or recombinant CTLA-4BP polypeptide sequence selected from at least one of SEQ ID NOS:69–92, 222–272, and 286–288, wherein the fragment binds or specifically binds with a CD28 and/or CTLA4 receptor and/or inhibits T cell activation or proliferation as described herein for CTLA-4BP polypeptides, and further provided the fragment itself is not an amino acid fragment known in the art to have such properties. Fragments of SEQ ID NOS: 93–94 having such properties as described for either of CTLA-4BP or CD28 polypeptides are also included.

Also provided are polypeptide sequences corresponding to at least one of the following components of any of SEQ ID NOS:48–94, 174–252, 263–272, and/or 283–293: a signal peptide, ECD, transmembrane domain, cytoplasmic domain, or mature region or any combination thereof of such components, such as, e.g., a signal peptide and ECD. A recombinant polypeptide comprising one or more of any of these individual components from one such sequence fused to one or more of these individual components at least one additional sequence is also contemplated in the invention.

Making Polypeptides

Recombinant methods for producing and isolating NCSM polypeptides of the invention are described above. In addition to recombinant production, the polypeptides may be produced by direct peptide synthesis using solid-phase techniques (see, e.g., Stewart et al. (1969) *Solid-Phase Peptide Synthesis*, W H Freeman Co, San Francisco; Merrifield J. (1963) *J. Am Chem Soc* 85:2149–2154). Peptide synthesis may be performed using manual techniques or by automation. Automated synthesis may be achieved, for example, using Applied Biosystems 431A Peptide Synthesizer (Perkin Elmer, Foster City, Calif.) in accordance with the instructions provided by the manufacturer. For example, subsequences may be chemically synthesized separately and combined using chemical methods to provide full-length NCSM polypeptides or fragments thereof. Alternatively, such sequences may be ordered from any number of companies which specialize in production of polypeptides. Most commonly, NCSM polypeptides are produced by expressing coding nucleic acids and recovering polypeptides, e.g., as described above.

Methods for producing the polypeptides of the invention are also included. One such method comprises introducing into a population of cells any NCSM nucleic acid described herein, which is operatively linked to a regulatory sequence effective to produce the encoded polypeptide, culturing the cells in a culture medium to produce the polypeptide, and isolating the polypeptide from the cells or from the culture medium. An amount of nucleic acid sufficient to facilitate uptake by the cells (transfection) and/or expression of the NCSM polypeptide is utilized. The culture medium can be any described herein and in the Examples. The nucleic acid is introduced into such cells by any delivery method described herein, including, e.g., injection, gene gun, passive uptake, etc. The NCSM nucleic acid may be part of a vector, such as a recombinant expression vector, including a DNA plasmid vector, or any vector described herein. The nucleic acid or vector comprising a NCSM nucleic acid may be prepared and formulated as described herein, above, and in the Examples below. Such a nucleic acid or expression vector may be introduced into a population of cells of a mammal in vivo, or selected cells of the mammal (e.g., tumor cells) may be removed from the mammal and the nucleic acid expression vector introduced ex vivo into the population of such cells in an amount sufficient such that uptake and expression of the encoded polypeptide results. Or, a nucleic acid or vector comprising a NCSM nucleic acid is produced using cultured cells in vitro. In one aspect, the method of producing a NCSM polypeptide comprises introducing into a population of cells a recombinant expression vector comprising any NCSM nucleic acid described herein in an amount and formula such that uptake of the vector and expression of the NCSM polypeptide will result; administering the expression vector into a mammal by any introduction/delivery format described herein; and isolating the polypeptide from the mammal or from a byproduct of the mammal.

Using Polypeptides

Antibodies

In another aspect of the invention, a NCSM polypeptide or fragments thereof of the invention is used to produce antibodies which have, e.g., diagnostic, therapeutic, or prophylactic uses, e.g., related to the activity, distribution, and expression of NCSM polypeptides and fragments thereof. Antibodies to NCSM polypeptides or peptide fragments thereof of the invention may be generated by methods well known in the art. Such antibodies may include, but are not limited to, polyclonal, monoclonal, chimeric, humanized, single chain, Fab fragments and fragments produced by a Fab expression library. Antibodies, e.g., those that block receptor binding, are especially preferred for therapeutic and/or prophylactic use.

NCSM polypeptides for antibody induction do not require biological activity; however, the polypeptides or oligopeptides are antigenic. Peptides used to induce specific antibodies may have an amino acid sequence consisting of at least about 10 amino acids, preferably at least about 15 or 20 amino acids or at least about 25 or 30 amino acids. Short stretches of a NCSM polypeptide may be fused with another protein, such as keyhole limpet hemocyanin, and antibody produced against the chimeric molecule.

Methods of producing polyclonal and monoclonal antibodies are known to those of skill in the art, and many antibodies are available. See, e.g., *Current Protocols in Immunology*, John Colligan et al., eds., Vols. I–IV (John Wiley & Sons, Inc., NY, 1991 and 2001 Supplement); and Harlow and Lane (1989) *Antibodies: A Laboratory Manual* Cold Spring Harbor Press, NY; Stites et al. (eds.) *Basic and Clinical Immunology* (4th ed.) Lange Medical Publications, Los Altos, Calif., and references cited therein; and Goding (1986) *Monoclonal Antibodies: Principles and Practice* (2d ed.) Academic Press, New York, N.Y.; and Kohler and Milstein (1975) *Nature* 256:495–497. Other suitable techniques for antibody preparation include selection of libraries of recombinant antibodies in phage or similar vectors. See, Huse et al. (1989) *Science* 246:1275–1281; and Ward et al. (1989) *Nature* 341:544–546. Specific monoclonal and polyclonal antibodies and antisera will usually bind with a $K_D$ of at least about 0.1 µM, preferably at least about 0.01 82 M or better, and most typically and preferably, 0.001 µM or better.

Detailed methods for preparation of chimeric (humanized) antibodies can be found in U.S. Pat. No. 5,482,856. Additional details on humanization and other antibody production and engineering techniques can be found in Borrebaeck (ed.) (1995) *Antibody Engineering, $2^{nd}$ Edition* Freeman and Company, NY (Borrebaeck); McCafferty et al. (1996) *Antibody Engineering, A Practical Approach* IRL at Oxford Press, Oxford, England (McCafferty), and Paul (1995) *Antibody Engineering Protocols* Humana Press, Towata, N.J. (Paul).

In one useful embodiment, this invention provides for fully humanized antibodies against the NCSM polypeptides of the invention or fragments thereof. Humanized antibodies are especially desirable in applications where the antibodies are used as therapeutics and/or prophylactics in vivo in human patients. Human antibodies consist of characteristically human immunoglobulin sequences. The human antibodies of this invention can be produced in using a wide variety of methods (see, e.g., Larrick et al., U.S. Pat. No. 5,001,065, and Borrebaeck McCafferty and Paul, supra, for a review). In one embodiment, the human antibodies of the present invention are produced initially in trioma cells. Genes encoding the antibodies are then cloned and expressed in other cells, such as nonhuman mammalian cells. The general approach for producing human antibodies by trioma technology is described by Ostberg et al. (1983), *Hybridoma* 2:361–367, Ostberg, U.S. Pat. No. 4,634,664, and Engelman et al., U.S. Pat. No. 4,634,666. The antibody-producing cell lines obtained by this method are called triomas because they are descended from three cells—two human and one mouse. Triomas have been found to produce antibody more stably than ordinary hybridomas made from human cells.

Sequence Variations
  Conservatively Modified Variations
  NCSM polypeptides of the present invention include conservatively modified variations of the sequences of any of SEQ ID NOS:48–94, 174–252, 263–272, and 283–293 and fragments thereof. Such conservatively modified variations comprise substitutions, additions or deletions that alter, add or delete a single amino acid or a small percentage of amino acids ( typically less than about 5%, more typically less than about 4%, 2%, or 1%) in any of SEQ ID NOS: 48–94, 174–252, 263–272, and 283–293.

For example, a conservatively modified variation (e.g., a deletion) of the 296 amino acid polypeptide identified herein as SEQ ID NO:48 will have a length of about 282 amino acids, preferably about 285 amino acids, more preferably about 288 amino acids, still more preferably about 291 amino acids, and still even more preferably about 294 amino acids or more, corresponding to a deletion of less than about 5%, 4%, 3%, 2%, or 1% of the polypeptide sequence.

Another example of a conservatively modified variation (e.g., a "conservatively substituted variation") of the polypeptide identified herein as SEQ ID NO:48 will contain "conservative substitutions," according to the six substitution groups set forth in Table 2 (supra), in up to about 15 residues (i.e., less than about 5%) of the 296 amino acid polypeptide.

As an example, if four conservative substitutions were localized in the region corresponding to amino acids 69–94 of SEQ ID NO:48, examples of conservatively substituted variations of this region, QKDSK MVLAI LPGKV QVWPE YKNRTI, would include:

NKDSK MV<u>V</u>AI LPGKV QV<u>F</u>PE YKN<u>K</u>TI and

QKD<u>A</u>K MVLAI LPGR<u>V</u>Q<u>M</u>WPE YK<u>Q</u>RTI and the like, where conservative substitutions are underlined.

The NCSM polypeptide sequences of the invention or fragments thereof, including conservatively substituted sequences, can be present as part of larger polypeptide sequences such as occur upon the addition of one or more domains for purification of the protein (e.g., poly-his segments, FLAG tag segments, etc.). These additional functional domains either have little or no effect on the activity of the NCSM portion of the protein, or the additional domains can be removed by post synthesis processing steps such as by treatment with a protease, inclusion of an intein, or the like.

Defining NCSM Polypeptides by Immunoreactivity

A further indication that two nucleic acid sequences or polypeptides are substantially identical is that the polypeptide encoded by the first nucleic acid is immunologically cross reactive with, or specifically binds to, the polypeptide encoded by the second nucleic acid. A polypeptide is typically substantially identical to a second polypeptide, e.g., where the two peptides differ only by conservative substitutions.

The phrase "specifically (or selectively) binds," "specifically (or selectively bound," or "specifically (or selectively) immunoreactive with," when referring to a polypeptide, refers to a binding reaction with an antibody which is determinative of the presence of the polypeptide, or an epitope from the polypeptide, in the presence of a heterogeneous population of polypeptides and other biologics. Specific binding between an antibody or other binding agent and an antigen generally means a binding affinity of at least about $10^5$ to $10^6$ $M^{-1}$.

Thus, under designated immunoassay conditions, the specified antibodies bind to a particular polypeptide and do not bind in a significant amount to other polypeptides present in the sample. The antibodies raised against a multivalent antigenic polypeptide will generally bind to the polypeptides from which one or more of the epitopes were obtained. Specific binding to an antibody under such conditions may require an antibody that is selected for its specificity for a particular polypeptide. A variety of immunoassay formats may be used to select antibodies specifically immunoreactive with a particular polypeptide. For example, solid-phase ELISA immunoassays, Western blots, or immunohistochemistry are routinely used to select monoclonal antibodies specifically immunoreactive with a protein. See Harlow and Lane (1988) *Antibodies, A Laboratory Manual*, Cold Spring Harbor Publications, New York (hereinafter "Harlow and Lane"), for a description of immunoassay formats and conditions that can be used to determine specific immunoreactivity. Typically, a specific or selective reaction is at least twice background signal or noise and more typically 2.5×–5× or more than 10 to 100 times background.

The polypeptides of the invention provide structural features that can be recognized, e.g., in immunological assays. The generation of antisera containing antibodies (for at least one antigen) which specifically binds the polypeptides of the invention, as well as the polypeptides which are bound by such antisera, are a feature of the invention. Preferred binding agents, including antibodies described herein, bind NCSM polypeptides and fragments thereof with affinities of at least about $10^6$ to $10^7$ $M^{-1}$, and preferably $10^8$ $M^{-1}$ to $10^9$ $M^{-1}$ or $10^{10}$ $M^{-1}$. Conventional hybridoma technology can be used to produce antibodies having affinities of up to about $10^9$ M-1. However, new technologies, including phage display and transgenic mice, can be used to achieve higher affinities (e.g., up to at least about $10^{12}$ $M^{-1}$). In general, a higher binding affinity is advantageous.

The invention includes NCSM polypeptides and fragments thereof that specifically bind to or that are specifically immunoreactive with an antibody or polyclonal antisera generated against at least one immunogen comprising at least one amino acid sequence selected from one or more of SEQ ID NOS:48–94, 174–252, 263–272, and 283–293 or fragments thereof. To eliminate cross-reactivity with other peptides, the antibody or antisera is subtracted with polypeptides encoded by sequences such as, e.g., those represented at GenBank accession numbers A92749, A92750, AA983817, AB026121, AB030650, AB030651, AB038153, AF010465, AF065893, AF065894, AF065895, AF065896, AF079519, AF106824, AF106825, AF106828, AF106829, AF106830, AF106831, AF106832, AF106833, AF106834, AF203442, AF203443, AF216747, AF257653, AH004645, AH008762, AX000904, AX000905, D49843, L12586, L12587, M27533, M83073, M83074, M83075, M83077, NM005191, S74541, S74540, S74695, S74696, U05593, U10925, U19833, U19840, U26832, U33063, U33208, U57755, U88622, X60958, Y08823, and Y09950. Where the GenBank sequence corresponds to a nucleic acid, a polypeptide encoded by the nucleic acid is generated and used for antibody/antisera subtraction purposes. Where the nucleic acid corresponds to a non-coding sequence, e.g., a pseudogene, an amino acid which corresponds to the reading frame of the nucleic acid is generated (e.g., synthetically), or is minimally modified, e.g., to include a start codon, promoter or the like for recombinant production.

In one typical format, the immunoassay uses a polyclonal antiserum which was raised against one or more NCSM polypeptides comprising one or more of the sequences corresponding to one or more of SEQ ID NOS:48–94, 174–252, 263–272, and 283–293, or a substantial subsequence or fragment thereof (i.e., comprising at least about 30%, 40%, 50%, 60%, 70%, 80%, 90% or more of the amino acids of the full length sequence provided). The full set of potential polypeptide immunogens derived from SEQ ID NOS:48–94, 174–252, 263–272, and 283–293 are collectively referred to herein as "the immunogenic polypeptides." The resulting antisera is optionally selected to have low cross-reactivity against the control, e.g., co-stimulatory homologues and any such cross-reactivity is removed by immunoabsorbtion with one or more of the control polypeptides, prior to use of the polyclonal antiserum in the immunoassay. Sequences which are substantially identical to such sequences can also be used, e.g., which are at least about 60%, 70%, 75%, 80%, 85%, 88%, 90%, 91%, 92%, 93%, 94%, 95%, 96%, 97%, 98%, 99%, 99.5% or more identical, e.g., as determined using BLAST or the other algorithms described herein and above, e.g., using default parameters.

In another aspect, the invention provides an antibody or antisera produced by administering a NCSM polypeptide of the invention to a mammal, which antibody specifically binds one or more antigen, the antigen comprising a polypeptide comprising one or more of the amino acid sequences SEQ ID NOS:48–94, 174–252, 263–272, and 283–293, which antibody does not specifically bind to a polypeptide encoded by one or more of GenBank Nucleotide Accession Nos: A92749, A92750, AA983817, AB026121, AB030650, AB030651, AB038153, AF010465, AF065893, AF065894, AF065895, AF065896, AF079519, AF106824, AF106825, AF106828, AF106829, AF106830, AF106831, AF106832, AF106833, AF106834, AF203442, AF203443, AF216747, AF257653, AH004645, AH008762, AX000904, AX000905, D49843, L12586, L12587, M27533, M83073, M83074, M83075, M83077, NM005191, S74541, S74540, S74695, S74696, U05593, U10925, U19833, U19840, U26832, U33063, U33208, U57755, U88622, X60958, Y08823, and Y09950.

Also included is an antibody or antisera which specifically binds a polypeptide comprising a sequence selected from: SEQ ID NOS:48–94, 174–252, 263–272, and 283–293, wherein the antibody does not specifically bind to a polypeptide encoded by one or more of GenBank Nucleotide Accession Nos. set forth above.

In order to produce antisera for use in an immunoassay, one or more of the immunogenic polypeptides is produced and purified as described herein. For example, recombinant protein may be produced in a mammalian cell line. An inbred strain of mice (used in this assay because results are more reproducible due to the virtual genetic identity of the mice) is immunized with the immunogenic protein(s) in combination with a standard adjuvant, such as Freund's adjuvant, and a standard mouse immunization protocol (see Harlow and Lane, supra, for a standard description of antibody generation, immunoassay formats and conditions that can be used to determine specific immunoreactivity). Alternatively, one or more synthetic or recombinant polypeptides derived from the sequences disclosed herein is conjugated to a carrier protein and used as an immunogen.

Polyclonal antisera are collected and titered against the immunogenic polypeptide in an immunoassay, for example, a solid phase immunoassay with one or more of the immunogenic proteins immobilized on a solid support. Polyclonal antisera with a titer of $10^6$ or greater are selected, pooled and subtracted with the control co-stimulatory polypeptides to produce subtracted pooled titered polyclonal antisera.

The subtracted pooled titered polyclonal antisera are tested for cross reactivity against the control polypeptides. Preferably at least two of the immunogenic NCSM polypeptides are used in this determination, preferably in conjunction with at least two of the control polypeptides, to identify antibodies which are specifically bound by the immunogenic polypeptide(s).

In this comparative assay, discriminatory binding conditions are determined for the subtracted titered polyclonal antisera which result in at least about a 5–10 fold higher signal to noise ratio for binding of the titered polyclonal antisera to the immunogenic NCSM molecules as compared to binding to any control polypeptides. That is, the stringency of the binding reaction is adjusted by the addition of non-specific competitors such as albumin or non-fat dry milk, or by adjusting salt conditions, temperature, or the like. These binding conditions are used in subsequent assays for determining whether a test polypeptide is specifically bound by the pooled subtracted polyclonal antisera. In particular, test polypeptides which show at least a 2–5× higher signal to noise ratio than the control polypeptides under discriminatory binding conditions, and at least about a ½ signal to noise ratio as compared to the immunogenic polypeptide(s), share substantial structural similarity with the immunogenic polypeptides as compared relative to known B7-1 or related co-stimulatory polypeptides, and are thus NCSM polypeptides of the invention.

In another example, immunoassays in the competitive binding format are used for detection of a test polypeptide. For example, as noted, cross-reacting antibodies are removed from the pooled antisera mixture by immunoabsorption with the control polypeptides. The immunogenic polypeptide(s) are then immobilized to a solid support which is exposed to the subtracted pooled antisera. Test proteins are added to the assay to compete for binding to the pooled subtracted antisera. The ability of the test protein(s) to compete for binding to the pooled subtracted antisera as compared to the immobilized protein(s) is compared to the ability of the immunogenic polypeptide(s) added to the assay to compete for binding (the immunogenic polypeptides compete effectively with the immobilized immunogenic polypeptides for binding to the pooled antisera). The percent cross-reactivity for the test proteins is calculated, using standard calculations.

In a parallel assay, the ability of the control proteins to compete for binding to the pooled subtracted antisera is determined as compared to the ability of the immunogenic polypeptide(s) to compete for binding to the antisera. Again, the percent cross-reactivity for the control polypeptides is calculated, using standard calculations. Where the percent cross-reactivity is at least 5–10× as high for the test polypeptides, the test polypeptides are said to specifically bind the pooled subtracted antisera.

In general, the immunoabsorbed and pooled antisera can be used in a competitive binding immunoassay as described herein to compare any test polypeptide to the immunogenic polypeptide(s). In order to make this comparison, the two polypeptides are each assayed at a wide range of concentrations and the amount of each polypeptide required to inhibit 50% of the binding of the subtracted antisera to the immobilized protein is determined using standard techniques. If the amount of the test polypeptide required is less than twice the amount of the immunogenic polypeptide that is required, then the test polypeptide is said to specifically bind to an antibody generated to the immunogenic protein, provided the amount is at least about 5–10× as high as for a control polypeptide.

As a final determination of specificity, the pooled antisera is optionally fully immunoabsorbed with the immunogenic polypeptide(s) (rather than any control polypeptides) until little or no binding of the resulting immunogenic polypeptide subtracted pooled antisera to the immunogenic polypeptide(s) used in the immunoabsorption is detectable. This fully immunoabsorbed antisera is then tested for reactivity with the test polypeptide. If little or no reactivity is observed (i.e., no more than 2× the signal to noise ratio observed for binding of the fully immunoabsorbed antisera to the immunogenic polypeptide), then the test polypeptide is specifically bound by the antisera elicited by the immunogenic protein.

Proliferation/Activation and Anti-proliferation/Inactivation Properties of NCSM Molecules The effect of the NCSM polypeptides and fragments thereof was examined on T cells as described in the Examples, infra. The results indicate that compositions comprising a NCSM polypeptide of the present invention or fragment thereof, or a soluble NSCM-ECD and NCSM-ECD-Ig, can be used in methods of the invention to induce or inhibit proliferation and/or activation of T cells, for example, in conjunction with stimulation of T cell receptor (e.g., by antigen or antiCD3 Ab). The ability of a NCSM polypeptide or fragment thereof to induce or inhibit T cell proliferation/activation is typically measured against the ability of wild-type B7-1 (such as, e.g., a human, primate, or cow B7-1) to induce or inhibit T cell proliferation or activation, e.g., in conjunction with stimulation of T cell receptor (e.g., by antigen or antiCD3 Ab). Similarly, a NCSM polynucleotide that encodes such a NCSM polypeptide or fragment thereof, or a soluble NSCM-ECD and NCSM-ECD-Ig, can be used in methods of the invention to induce or inhibit proliferation and/or activation of T cells by using e.g., cells transfected with and expressing or secreting such NCSM molecules. Here, too, the ability of the expressed or secreted NCSM peptide molecule to induce or inhibit T cell proliferation and/or activation is measured in the same manner.

Inducing or inhibiting of proliferation/activation of T cells can be performed in vitro (as useful, e.g., in a variety of proliferation assays or in generation of, e.g., tumor-antigen specific T cells that can be administered to cancer patients), or in vivo (as useful, e.g., as a therapeutic and/or prophylactic).

CD28BPs and CTLA-4BPs of the invention (and fragments thereof) and the nucleic acids encoding such CD28BPs and CTLA-4BPs of the invention (and fragments thereof) are useful in numerous applications, either when used as gene-based therapeutics/vaccines or when administered as, e.g., soluble polypeptides, proteins, or fragments thereof, in the presence or absence of a specific antigen or mixture of antigens.

Compositions of the present invention can be used to prophylactically or therapeutically treat and thereby prevent, alleviate or ameliorate a variety of conditions where stimulation of T cell proliferation/activation or inhibition of T cell proliferation and/or activation would be beneficial to a patient. Such uses include, but are not limited to, e.g., prophylaxis of infectious disease, therapeutic and prophylactic treatment of a variety of chronic infectious diseases, cancers, allergies, autoimmune diseases, septic shock, prevention and treatment of graft versus host disease, and the like; and the prevention of organ transplant rejection and the like.

The products of the invention can also be used in gene therapy to reduce immune system recognition of cells expressing a transgene, thus prolonging the longevity of the expression of the transgene. Generation of transgenic animals expressing products of the invention optionally can be used as sources of organs for humans (e.g., the organs could express a CTLA-4BP of the invention which, on the surface of the organ, down-regulates host T cell responses thus reducing risk of rejection), etc.

A desired goal in developing CTLA-4BPs was to create NCSM molecules that specifically signal through CTLA-4 and thus can, e.g., induce tolerance, suppress activated T cells, and induce regulatory T cells. Other routes of modifying immune responses (e.g., nonspecific immunosuppression with cyclosporin A, blockage of APC—T cell interaction with CTLA-4-Ig or with Anti-B7 monoclonal antibodies (mAbs), or blockage of APC—B-cell activation with Anti-CD40L Abs) have drawbacks (e.g., they induce general immunosuppression or they inhibit T cell growth, etc.) and do not achieve the goal of CTLA-4BPs of the invention, namely induction of tolerance of antigen-specific T cells. An example (but not limiting) application of CTLA-4BP in gene therapy is illustrated by, e.g., using a vector encoding a CTLA-4BP and a transgene (alternatively the CTLA-4BP and transgene can be on separate plasmids) which is introduced into a target cell and whose gene products are presented on the same cell surface. The transgene (in context with MCH) interacts with the T cell receptor (TCR) on the T cell while the CTLA-4BP interacts with CTLA-4 on the T cell, all of which leads to an inhibition or reduction of T cell response and a prolonged expression of the transgene.

The products (i.e., polypeptides, nucleic acids, and fragments thereof) of the present invention can be useful in such things as vaccine adjuvants (e.g., genetic vaccines, protein vaccines, attenuated or killed viral vaccines). For example, the nucleic acids of CD28BPs and CTLA-4BPs (or fragments thereof) can be components of genetic vaccines and gene therapy vectors (e.g., DNA vaccines, viral vectors), or they can be expressed in cells of interest (e.g., tumor cells, dendritic cells) which then can be used as vaccines or therapeutics. Additionally, products of the invention can be transfected into tumor cells which, after being rendered unable to proliferate (e.g., by irradiation) then can be used as cell-based vaccines. Alternatively, such transfected cells are lysed and the resulting lysate used as a vaccine.

Use of a wild-type human B7 gene as a component in a DNA vaccine along with an antigen(s) of interest results in both positive and negative signals to T cells since wild-type human B7 can bind with both CD28 and CTLA-4 on T cells. However, DNA vaccines encoding a product of the invention, e.g., CD28BP or fragments thereof, can selectively tailor the T cell response, e.g., CD28BP in a DNA vaccine will result in positive signals to T cells (e.g., signals to induce T cell proliferation/activation). For example, a CD28BP is optionally used in a treatment vaccine for melanoma (in the context of TRP-1, TRP-2 and/or tyrosinase). An illustrative, but not limiting example is: intradermal injection of DNA (antigen) followed by subcutaneous injection of protein (CD28BP) with time periods of, e.g., 2 weeks between treatments for, e.g., 4 cycles. The CD28BP presents low risk of cross-reactivity with wild-type in treatment of life threatening melanoma. Fragments of the CD28BP encoding nucleic acid are optionally used in the procedure. As another illustrative, but not limiting example, CTLA-4BPs of the invention or fragments thereof are optionally used in conjunction with MBP (myelin basic protein) in a treatment vaccine for multiple sclerosis which is given, e.g., as an intramuscular injection every 3 weeks for 6 months or as the condition warrants.

A gene-based vaccine utilizing a NCSM (e.g., a CD28BP or CTLA-4BP) or fragments thereof is optionally comprised of a plasmid encoding both the antigen(s) of interest and the NCSM (e.g., either CD28BP or CTLA-4BP) (alternatively, the antigen(s) of interest could be on a separate plasmid from the NCSM gene (e.g., the CD28BP or CTLA-4BP gene(s)). The products of the genes of the plasmid(s) are expressed on the surface of, e.g., an APC. Interaction occurs between the antigen of interest (in the context of MHC) and CD28BP (both on the, e.g., APC) with, respectively, the T cell receptor and CD28 on the T cell which leads to T cell proliferation/activation. Optionally, interaction occurs between the antigen of interest (in the context of MHC) and CTLA-4BP (both on the, e.g., APC) with, respectively, the TCR and CTLA-4 on the T cell which leads to T cell anergy/tolerance.

Another example of CD28BP application is illustrated by inducing specific T cell activation through use of a plasmid encoding a CD28BP or fragments thereof. The plasmid is transfected into a tumor cell (e.g., ex vivo), which is, e.g., irradiated to stop proliferation, and is then used as a vaccine (or optionally a tumor cell lysate, e.g., Melacine ® is used). The tumor antigens are presented (in context with MHC) to the T cell and interact with the TCR. Additionally, the CD28BP expressed on the cell along with the tumor antigen is presented to the T cell and interacts with CD28, thus leading to T cell activation.

Soluble NCSM Polypeptides and Nucleic Acids

The present invention provides soluble NCSM polypeptides (or fragments thereof) and nucleic acids encoding them. Selected regions (e.g., the ECD, truncated extracellular domain, secreted subsequence of a NCSM polypeptide) or fragments thereof are provided in both polypeptide and nucleic acid format. These soluble molecules are suited for use as prophylactics, therapeutics, and/or diagnostic tools and can be targeted or designed for specific actions and a variety of applications as described herein.

Soluble B7-1 proteins and fragments have been described and characterized. See, e.g., U.S. Pat. No. 6,071,716. Standard procedures for expressing soluble B7-1 proteins and fragments thereof, recovering such molecules from culture media, screening and characterizing such molecules for e.g., T cell proliferation or lymphokine production, as described in, e.g., U.S. Pat. No. 6,071,716, can be used and applied to soluble NCSM polypeptides and fragments thereof of the present invention.

A "soluble" NCSM polypeptide, such as a soluble CD28BP or CTLA-4BP of the invention, means a polypeptide comprising an amino acid sequence that corresponds to that of the extracellular domain (ECD) of a NCSM polypeptide or a fragment of said ECD (e.g., a truncated ECD). The soluble NCSM polypeptide typically does not include the amino acid sequences corresponding to the full-length cytoplasmic or transmembrane domain. The amino acid sequence corresponding to the signal peptide or leader, or a fragment thereof, may or may not be included in the soluble NCSM polypeptide. A soluble NSCM polypeptide may further comprise an immunoglobulin (Ig) or Ig fragment, such as, e.g., an Fc portion of an Ig (e.g., IgG) linked to an NCSM ECD or fragment thereof. In one aspect, a soluble NCSM polypeptide comprises a fusion protein comprising an NCSM ECD or fragment thereof and an Ig or fragment thereof, including, e.g., an Fc portion. The Ig may be from a human, primate, or other mammal. A soluble NCSM polypeptide is freely secreted into the medium surrounding a host cell when it is recombinantly produced in the host cell. Nucleic acids encoding any such soluble NCSM polypeptides (or fragments thereof) described above and hereinafter are also an aspect of the invention.

For each NCSM molecule of the invention, a putative ECD polypeptide sequence (or nucleotide sequence encoding said polypeptide sequence) may be determined by alignment of the NCSM ECD polypeptide sequence (or nucleotide sequence encoding same) with an analogous ECD polypeptide sequence (or nucleotide sequence encoding same) of human B7-1 or other mammalian B7-1 (e.g., primate). The putative amino acid and nucleic acid sequences corresponding to the respective putative signal peptide, transmembrane domain, cytoplasmic domain, and mature region can also be similarly determined for each NCSM molecule of the invention. It is readily understood by one of ordinary in the art that each of these domains/regions of the NCSM polypeptides and polynucleotides determined by such alignment comparison is putative and thus may vary in length by one or more amino acids or nucleic acids, respectively. One of skill can readily confirm such domains/regions by other analyses known in the art, including those used to determine corresponding domains/regions in hB7-1.

The soluble NCSM molecules can show preferential binding to either CTLA-4 or CD28 receptor. Soluble CD28BPs (and fragments thereof) can bind preferentially with CD28 and CTLA-4BPs (and fragments thereof) can bind preferentially with CTLA-4 as compared to the binding of soluble wild-type (WT) human B7-1 to CD28 and CTLA-4. For example, when an antigen is presented (in context with MHC) on the surface of a cell where it interacts with the TCR on a T cell, a soluble CD28BP optionally can interact simultaneously with the T cell through the CD28 molecule, thus leading to T cell proliferation/activation. Conversely, when an antigen is presented (in context with MHC) on the surface of a cell where it interacts with the TCR on a T cell while simultaneously a soluble CTLA-4BP also interacts with the T cell (through the CTLA-4 molecule), T cell anergy/tolerance can result.

Optionally, and additionally, the soluble NCSM molecules of the invention, or fragments thereof, can be used as agonists or antagonists of the respective T cell receptors. The soluble CD28BP molecules can optionally act as agonists by stimulating T cell proliferation/activation by binding with CD28 or the soluble CD28BP molecules can optionally act as antagonists by binding with CD28 without stimulating T cell proliferation/activation. Furthermore, soluble CTLA-4BP molecules can optionally act as agonists by binding with CTLA-4 and inhibiting T cell proliferation/activation (e.g., not stimulating T cells) or the soluble CTLA-4BP molecules can act as antagonists by binding with CTLA-4 and not inhibiting T cell proliferation/activation.

These soluble NCSM molecules can be delivered to a subject by a variety of formats. For example, the soluble NCSM molecules can be delivered as polypeptides or proteins (or fragments thereof) or as nucleic acids (or fragments thereof) encoding such polypeptides or proteins.

The present invention also provides fusion proteins comprising a fusion of a protein (such as a CD28BP or CTLA-4BP of the current invention) or fragments thereof with an immunoglobulin or portion of an immunoglobulin. The resulting protein-Ig fusions (or immunoadhesions or Fc-fusion proteins) can show improved pharmacokinetics, such as longer half-life in vivo, and increased expression. Such fusion proteins can also simplify purification and augment isotype effector functions for specific proteins. See, e.g., Ashkenazi, A. et al. (1997) *Curr Op in Immunol* 9(2): 195–200 for a review of the uses and applications of Ig-protein fusions. The NCSMs of the invention can be fused to many variations of, e.g., immunoglobulins and the NCSM fusions are not limited by, e.g., the type of Ig molecule used. In addition to full length NCSM molecules, fragments of NCSM molecules (e.g., the extracellular domain (ECD) or fragments of the ECD) can be fused to Ig molecules. Various sequences, e.g., linker sequences, proteolytic cleavage sites (such as, e.g., Factor Xa cleavage site), etc., can also be incorporated into the NCSM-Ig fusion protein. Nucleotide sequences encoding such NCSM-Ig fusion proteins are another aspect of the invention.

A fusion protein comprising a NCSM polypeptide or fragment thereof fused to human IgG Fc domain is an aspect of the present invention, see, e.g., Example 4, infra. The NCSM-Ig fusion proteins have the benefits of being soluble (thus, e.g., expanding their uses as prophylactics and therapeutics) and being stabilized by the Ig portion of the fusion. The soluble NCSM polypeptide-IgG fusion proteins of the present invention are suited for use as prophylactics and/or therapeutics since they can be targeted or tailored for specific actions and a variety of applications.

The NCSM-Ig fusion proteins and polypeptides of the invention can be used for, e.g., similar applications (including, e.g., therapeutic, prophylactic, and diagnostic applications described herein) as the NCSM proteins and polypeptides of the invention (as indicated throughout). These Ig-fusion proteins of the invention also show preferential binding to either CTLA-4 or CD28. CD28BP-Ig fusions (and fragments thereof) bind preferentially with CD28 and CTLA-4BP-Ig fusions (and fragments thereof) bind preferentially with CTLA-4 as compared to the binding of human B7-1 to CD28 and CTLA-4. For example, when an antigen is presented (in context with MHC) on the surface of a cell where it interacts with the TCR on a T cell, a soluble CD28BP-Ig fusion protein optionally can interact simultaneously with the T cell through the CD28 molecule, thus leading to T cell proliferation/activation. Conversely, when an antigen is presented (in context with MHC) on the surface of a cell where it interacts with the TCR on a T cell while simultaneously a soluble CTLA-4BP-Ig fusion protein also interacts with the T cell (through the CTLA-4 molecule), T cell anergy/tolerance can result.

Optionally, the soluble NCSM-Ig fusion proteins (e.g., CD28BP-Ig and CTLA-4BP-Ig), or fragments thereof, or proteins (or protein fusions) based on the NCSMs (e.g., CD28BPs or CTLA-4BPs) are used as agonists or antagonists of the respective receptors on the T cell. For example, CD28BP or CD28BP-Ig fusions acting as agonists by stimulating T cell proliferation/activation through binding to CD28 or as antagonists by binding to CD28 without inducing T cell proliferation/activation. Alternatively, CTLA-4 or CTLA-4BP-Ig fusions acting as agonists by inhibiting (or not stimulating) T cell proliferation/activation through binding to CTLA-4 or as antagonists by binding to CTLA-4 without inhibiting T cell proliferation/activation.

In one aspect, the IgG Fc hinge, CH2 and CH3 domains are modified or evolved using a recursive sequence recombination method, such as DNA shuffling, or another diversity generation method to produce a library of recombinant IgG Fc hinge CH2 and CH3 domains from a group of selected parental IgG Fc sequences, and then screening the library by appropriate screening procedures to identity a chimeric IgG Fc comprising at least one recombined Fc constant domain exhibiting reduced binding to at least one Fcγ receptor—e.g., FcγRII and FcγRIII. Specifically, the library of recombinant (shuffled) IgG molecules are digested with BsteII and EcoRI, and ligated into a BstEII—EcoRI digested plasmid comprising at least one NCSM nucleic acid sequence to produce a non- or reduced-FcγR binding NCSM-Ig fusion protein molecules. Supernatants from 293 cells transiently transfected with such expression plasmids are incubated with 293 cells expressing either FcγRII or FcγRIII, and binding affinity of the expressed recombinant clones is determined by FACS analysis methods using a NCSM-specific mAb conjugated with FITC. IgG Fc variants exhibiting reduced or no binding to one or more FcγR are used as fusion partners with one or more specific NCSMs of the present invention and are useful in the applications described above.

In addition to fusion with Ig sequences or regions, the fusion proteins of the invention can include any protein sequence in combination with the NCSM molecule, or fragment thereof. The invention also includes the nucleic acid sequence encoding any such fusion polypeptide. For example, a NCSM polypeptide of the invention or fragments thereof can be fused with polypeptide sequences which, e.g., enable sorting of the fusion proteins, e.g., fluorescence indicator molecules. Alternatively, the NCSM polypeptides or fragments thereof can be incorporated into fusion proteins that enable, e.g., targeting of the fusions to specific cell types or cells.

The fusion proteins of the present invention can be delivered to a subject by a variety of formats, including, e.g., as a polypeptide or protein, or as a nucleic acid encoding such polypeptide or protein as described in detail herein.

Therapeutic and Prophylactic Treatment Methods

The NCSM polynucleotides and polypeptides of the invention have properties that are of beneficial use in a variety of application, including, e.g., protein- and DNA-based vaccinations and in prophylactic and therapeutic disease treatments where manipulation of an immune response (e.g., inducing or suppressing), T cell activation or proliferation, and/or cytokine production is desirable.

In one aspect, the present invention includes methods of therapeutically or prophylactically treating a disease or disorder by administering, in vivo or ex vivo, one or more nucleic acids or fragments thereof or polypeptides or fragments thereof of the invention described above (or compositions, vectors, or transduced cells comprising a pharmaceutically acceptable excipient and one or more such nucleic acids or polypeptides) to a subject or to a population of cells of the subject, including, e.g., a mammal, including, e.g., a human, primate, monkey, orangutan, baboon, mouse, pig, cow, cat, goat, rabbit, rat, guinea pig, hamster, horse, sheep; or a non-mammalian vertebrate such as a bird (e.g., a chicken or duck) or a fish, or invertebrate.

In one aspect of the invention, in ex vivo methods, one or more cells or a population of cells of interest of the subject (e.g., tumor cells, tumor tissue sample, organ cells, blood cells, cells of the skin, lung, heart, muscle, brain, mucosae, liver, intestine, spleen, stomach, lymphatic system, cervix, vagina, prostate, mouth, tongue, etc.) are obtained or removed from the subject and contacted with an amount of a polypeptide of the invention that is effective in prophylactically or therapeutically treating a disease, disorder, or other condition. The contacted cells are then returned or delivered to the subject to the site from which they were obtained or to another site (e.g., including those defined above) of interest in the subject to be treated. If desired, the contacted cells may be grafted onto a tissue, organ, or system site (including all described above) of interest in the subject using standard and well-known grafting techniques or, e.g., delivered to the blood or lymph system using standard delivery or transfusion techniques.

The CD28BP polypeptides of the invention and/or nucleic acids of the invention can be used in methods to activate T cells ex vivo by, e.g., obtaining or removing T cells from a subject (e.g., mammal, such as a human) and administering to the subject a sufficient amount of one or more polypeptides of the invention to activate effectively the T cells (or administering a sufficient amount of one or more nucleic acids of the invention with a promoter such that uptake of the nucleic acid into one or more such T cells occurs and sufficient expression of the nucleic acid results to produce an amount of a polypeptide effective to activate said T cells. The activated T cells are then returned to the subject. T cells can be obtained or isolated from the subject by a variety of methods known in the art, including, e.g., by deriving T cells from peripheral blood of the subject or obtaining T cells directly from a tumor of the subject.

The CD28BP polypeptides of the invention and/or nucleic acids of the invention can be used to activate T cells ex vivo by, e.g., obtaining or removing cells (e.g., antigen presenting cells) from a subject (e.g., a mammal, such as a human) and administering to the removed cells a sufficient amount of one or more polypeptides of the invention to activate effectively T cells once the removed cells are returned to the subject (or administering a sufficient amount of one or more nucleic acids of the invention with a promoter such that uptake of the nucleic acid into one or more removed cell occurs and sufficient expression of the nucleic acid results to produce an amount of a polypeptide effective to activate T cells upon return of the removed cells to the subject).

The CTLA-4BP polypeptides of the invention and/or nucleic acids encoding polypeptides of the invention are useful in inhibiting T cell response (e.g., inhibiting T cell activation or proliferation) in a subject to which at least one at the polypeptides or nucleic acids of the invention is administered. In another aspect, the CTLA-4BP polypeptides of the invention and/or nucleic acids encoding polypeptides of the invention modulate T cell activation without completely inhibiting T cell proliferation following administration. In another aspect, the CTLA-4BP polypeptides of the invention and/or nucleic acids encoding polypeptides of the invention modulate T cell activation in a subject following administration, but do not induce proliferation of purified T cells activated by soluble monoclonal antibodies (e.g., anti-CD3 monoclonal antibodies that bind T cell receptor (TCR) on a T cell).

The invention also provides in vivo methods in which at least one cell or a population of cells of interest of the subject are contacted directly or indirectly with a sufficient amount of a NCSM polypeptide of the invention effective in prophylactically or therapeutically treating a disease, disorder, or other condition. In direct (e.g., local) contact or administration formats, the polypeptide is typically administered or transferred directly (e.g., locally) to the cells to be treated or to the tissue site of interest (e.g., tumor cells, tumor tissue sample, organ cells, blood cells, cells of the skin, lung, heart, muscle, brain, mucosae, liver, intestine, spleen, stomach, lymphatic system, cervix, vagina, prostate, mouth, tongue, etc.) by any of a variety of formats, including topical administration, injection (e.g., using a needle or syringe), or vaccine or gene gun delivery, or pushing into a tissue, organ, or skin site.

The NCSM molecule can be delivered by a variety of routes, e.g., intramuscularly, intradermally, subdermally, subcutaneously, orally, intraperitoneally, intrathecally, intravenously, or placed within a cavity of the body (including, e.g., during surgery), or by inhalation or vaginal or rectal administration.

In in vivo and ex vivo indirect contact/administration formats, the NCSM polypeptide is typically administered or transferred indirectly to the cells to be treated or to the tissue site of interest, including those described above (such as, e.g., skin cells, organ systems, lymphatic system, or blood cell system, etc.), by contacting or administering the NCSM polypeptide of the invention directly to one or more cells or population of cells from which treatment can be facilitated. For example, tumor cells within the body of the subject can be treated by contacting cells of the blood or lymphatic system, skin, or an organ with a sufficient amount of the polypeptide such that delivery of the polypeptide to the site of interest (e.g., tissue, organ, or cells of interest or blood or lymphatic system within the body) occurs and effective prophylactic or therapeutic treatment results. Such contact, administration, or transfer is typically made by using one or more of the routes or modes of administration described above.

In another aspect, the invention provides ex vivo methods in which one or more cells of interest or a population of cells of interest of the subject (e.g., tumor cells, tumor tissue sample, organ cells, blood cells, cells of the skin, lung, heart, muscle, brain, mucosae, liver, intestine, spleen, stomach, lymphatic system, cervix, vagina, prostate, mouth, tongue, etc.) are obtained or removed from the subject and transformed by contacting said one or more cells or population of cells with a polynucleotide construct comprising a target nucleic acid sequence of the invention or fragments thereof, that encodes a biologically active polypeptide of interest (e.g., a polypeptide of the invention) that is effective in prophylactically or therapeutically treating the disease, disorder, or other condition. The one or more cells or population of cells is contacted with a sufficient amount of the polynucleotide construct and a promoter controlling expression of said nucleic acid sequence such that uptake of the polynucleotide construct (and promoter) into the cell(s) occurs and sufficient expression of the target nucleic acid sequence of the invention results to produce an amount of the biologically active polypeptide effective to prophylactically or therapeutically treat the disease, disorder, or condition. The polynucleotide construct may include a promoter sequence (e.g., WT, recombinant, or chimeric CMV promoter sequence) that controls expression of a NCSM nucleic acid sequence of the invention and/or, if desired, one or more additional nucleotide sequences encoding at least one of another NCSM polypeptide, a cytokine, an adjuvant, or a co-stimulatory molecule, or other polypeptide of interest.

Following transfection, the transformed cells are returned, delivered, or transferred to the subject to the tissue site or system from which they were obtained or to another site (e.g., tumor cells, tumor tissue sample, organ cells, blood cells, cells of the skin, lung, heart, muscle, brain, mucosae, liver, intestine, spleen, stomach, lymphatic system, cervix, vagina, prostate, mouth, tongue, etc.) to be treated in the subject. If desired, the cells may be grafted onto a tissue, skin, organ, or body system of interest in the subject using standard and well-known grafting techniques or delivered to the blood or lymphatic system using standard delivery or transfusion techniques. Such delivery, administration, or transfer of transformed cells is typically made by using one or more of the routes or modes of administration described above. Expression of the target nucleic acid occurs naturally or can be induced (as described in greater detail below) and an amount of the encoded polypeptide is expressed sufficient and effective to treat the disease or condition at the site or tissue system.

In another aspect, the invention provides in vivo methods in which one or more cells of interest or a population of cells of the subject (e.g., including those cells and cell(s) systems and subjects described above) are transformed in the body of the subject by contacting the cell(s) or population of cells with (or administering or transferring to the cell(s) or population of cells using one or more of the routes or modes of administration described above) a polynucleotide construct comprising a nucleic acid sequence of the invention that encodes a biologically active polypeptide of interest (e.g., a polypeptide of the invention) that is effective in prophylactically or therapeutically treating the disease, disorder, or other condition.

The polynucleotide construct can be directly administered or transferred to cell(s) exhibiting or having the disease or disorder (e.g., by direct contact using one or more of the routes or modes of administration described above). Alternatively, the polynucleotide construct can be indirectly administered or transferred to cell(s) exhibiting or having the disease or disorder by first directly contacting non-diseased cell(s) or other diseased cells using one or more of the routes or modes of administration described above with a sufficient amount of the polynucleotide construct comprising the nucleic acid sequence encoding the biologically active polypeptide, and a promoter controlling expression of the nucleic acid sequence, such that uptake of the polynucleotide construct (and promoter) into the cell(s) occurs and sufficient expression of the nucleic acid sequence of the invention results to produce an amount of the biologically active polypeptide effective to prophylactically or therapeutically treat the disease or disorder, and whereby the polynucleotide construct or the resulting expressed polypeptide is transferred naturally or automatically from the initial delivery site, system, tissue or organ of the subject's body to the diseased site, tissue, organ or system of the subject's body (e.g., via the blood or lymphatic system). Expression of the target nucleic acid occurs naturally or can be induced (as described in greater detail below) such that an amount of the encoded polypeptide expressed is sufficient and effective to treat the disease or condition at the site or tissue system. The polynucleotide construct may include a promoter sequence (e.g., wild-type, recombinant or chimeric CMV promoter sequence) that controls expression of the nucleic acid sequence and/or, if desired, one or more additional nucleotide sequences encoding at least one of another NCSM polypeptide, a cytokine, an adjuvant, or a co-stimulatory molecule, or other polypeptide of interest.

In one aspect, tumor cells of a patient are transfected with a DNA plasmid vector encoding a NCSM polypeptide of interest (e.g., CD28BP) to facilitate an improved immune response, (e.g., enhanced T cell response or increased antibody titer). The tumor cells may be removed from the patient and transfected ex vivo, and then re-delivered to the patient, preferably at the tumor site. Alternatively, the tumor cells of a tumor are transfected in vivo, by delivering a DNA plasmid encoding a NCSM polypeptide of interest (e.g., CD28BP). In either case, the immune response can be measured by measuring T cell proliferation using methods described herein or antibody levels using standard protocols. In another aspect, a DNA plasmid encoding a soluble NCSM-ECD or soluble NCSM-ECD-Ig is administered to a patient by any means described herein, including systemically, subcutaneously, i.m., intradermally, etc. and the like, via a needle or gene gun or other introduction mechanism described herein; if desired, the plasmid is introduced directly into cells of a tumor or tumor-related cells of the patient.

In yet another aspect, a soluble NCSM-ECD polypeptide or soluble NCSM-ECD-Ig fusion protein is administered to a patient by any means described herein, including systemically, subcutaneously, i.m., intradermally, etc. and the like, via a needle or gene gun or other introduction mechanism described herein; if desired, the polypeptide or fusion protein is introduced directly into cells of a tumor or tumor-related cells of the patient. The soluble NCSM can be administered in conjunction with an antigen (either simultaneously or consecutively) as part of a vaccine protocol.

The NCSM polypeptides of the invention and the NCSM polynucleotides encoding them are also useful as vaccine adjuvants in vaccine applications as discussed herein and for diagnostic purposes, as for in vitro applications for testing and diagnosing such diseases. For example, a polynucleotide encoding a NCSM of the invention, (e.g., CD28BP) or an NCSM polypeptide (or fragment thereof, e.g., ECD, or fusion protein) can serve as an adjuvant to a DNA vaccine or protein vaccine by enhancing immune-stimulating properties of the antigen encoded by the DNA vaccine or the protein antigen itself, respectively. In any of these formats, the NCSM molecule that results may non-specifically enhance the immune response of the subject to an antigen.

In each of the in vivo and ex vivo treatment methods as described above, a composition comprising an excipient and the NCSM polypeptide or nucleic acid of the invention can be administered or delivered. In one aspect, a composition comprising a pharmaceutically acceptable excipient (e.g., PBS) and a NCSM polypeptide or nucleic acid of the invention is administered or delivered to the subject as described above in an amount effective to treat the disease or disorder.

In another aspect, in each in vivo and ex vivo treatment method described above, the amount of polynucleotide administered to the cell(s) or subject can be an amount sufficient that uptake of said polynucleotide into one or more cells of the subject occurs and sufficient expression of said nucleic acid sequence results to produce an amount of a biologically active NCSM polypeptide (e.g., ECD) effective to enhance an immune response in the subject, including an immune response induced by an immunogen (e.g., antigen). In another aspect, for each such method, the amount of polypeptide administered to cell(s) or subject can be an amount sufficient to enhance an immune response in the subject, including that induced by an immunogen (e.g., antigen).

In yet another aspect, in each in vivo and ex vivo treatment method described above, the amount of polynucleotide administered to the cell(s) or subject can be an amount sufficient that uptake of said polynucleotide into one or more cells of the subject occurs and sufficient expression of said nucleic acid sequence results to produce an amount of a biologically active polypeptide effective to produce a tolerance or anergy response in the subject. In another aspect, for each such method, the amount of polypeptide administered to cell(s) or subject can be an amount sufficient to produce a tolerance or anergy response in the subject.

The amount of DNA plasmid for use in such methods where administration is by injection is from about 50 micrograms (ug) to 5 mg, usually about 100 ug to about 2.5 mg, typically about 500 ug to 2 mg or about 800 ug to about 1.5 mg, and often about 1 mg. The amount of DNA plasmid for use in these methods where administration is via a gene gun, e.g., is from about 100 to 1000 times less; thus, for each range given above for DNA plasmid administration via injection, the range for DNA plasmid administration via gene gun would be about 100 to 1000 times less. For example, for gene gun delivery, the amount of DNA plasmid corresponding to the first range above would be from about $50 \times 10^{-8}$ g to $5 \times 10^{-5}$ g (100 times less) or from about $50 \times 10^{-9}$ to about $5 \times 10^{-6}$ g. DNA plasmid amounts can be readily adjusted by those of ordinary skill in the art based upon responses in animal models obtained using the DNA plasmid vector encoding WT hB7-1 and/or antigen or based upon known DNA vaccination studies using plasmid vectors encoding a mammalian B7-1, such as WT hB7-1. Such amounts of DNA plasmid can be used, if desired, in the method in Example VI.

In yet another aspect, in an in vivo or in vivo treatment method in which a polynucleotide construct (or composition comprising a polynucleotide construct) is used to deliver a physiologically active polypeptide to a subject, the expression of the polynucleotide construct can be induced by using an inducible on- and off-gene expression system. Examples of such on- and off-gene expression systems include the Tet-On™ Gene Expression System and Tet-Off™ Gene Expression System (see, e.g., Clontech Catalog 2000, pg. 110–111 for a detailed description of each such system), respectively. Other controllable or inducible on- and off-gene expression systems are known to those of ordinary skill in the art. With such system, expression of the target nucleic of the polynucleotide construct can be regulated in a precise, reversible, and quantitative manner. Gene expression of the target nucleic acid can be induced, for example, after the stable transfected cells containing the polynucleotide construct comprising the target nucleic acid are delivered or transferred to or made to contact the tissue site, organ or system of interest. Such systems are of particular benefit in treatment methods and formats in which it is advantageous to delay or precisely control expression of the target nucleic acid (e.g., to allow time for completion of surgery and/or healing following surgery; to allow time for the polynucleotide construct comprising the target nucleic acid to reach the site, cells, system, or tissue to be treated; to allow time for the graft containing cells transformed with the construct to become incorporated into the tissue or organ onto or into which it has been spliced or attached, etc.).

The present invention also provides a therapeutic method of activating or enhancing a T cell response in a subject suffering from a cancer, such as, e.g., where the subject has a tumor. The method comprises administering to the subject a composition that comprises a nucleotide sequence that encodes a soluble NCSM polypeptide and an excipient, wherein the NCSM polypeptide is expressed by the tumor cells or the tumor-related cells, and the T cell response is activated or enhanced against the tumor. The composition may be a pharmaceutical composition, and the excipient may be a pharmaceutically acceptable excipient. The pharmaceutical composition may comprise a nucleotide sequence encoding a soluble NCSM polypeptide (or fragment thereof having at least one NCSM property) and a pharmaceutically acceptable excipient. Such nucleotide sequence may be incorporated in a vector and may be operably linked to a promoter to facilitate expression.

In one embodiment, the composition comprising a nucleotide sequence encoding a soluble NCSM polypeptide (or fragment thereof having at least one NCSM property) and an excipient is administered to the subject by i.d., i.m. or, e.g., direct injection or via gene gun or other vaccine delivery device. The composition may be introduced or administered by a variety of routes, including, direct administration to the tumor or tumor site, if known, or administration systemically to the subject by direct injection or gene gun or the like. A sufficient amount of the composition is delivered such that transfection of the subject's tumor cells with the NCSM-polypeptide-encoding nucleotide sequence occurs and a T cell response or activation results. As described above, a DNA plasmid expression vector comprising the nucleotide sequence may be delivered as "naked" DNA or may be formulated with other components (e.g., calcium phosphate, lipids, etc.) to facilitate transfection. Exemplary amounts of the total DNA (e.g., in milligrams) (for the NCSM polynucleotide and vector) suggested for such treatment are described herein and in the Examples below. The amount of DNA plasmid may be a therapeutically effective amount to inhibit further growth of the tumor or kill the tumor. One of skill in the art can also determine a therapeutically effective DNA plasmid vector amounts based on known clinical studies to treat cancers using gene therapy or DNA vaccination methods and WT hB7-1 and mammalian models.

In another aspect, tumor cells are obtained from the subject (or alternatively allogeneic tumor cells are used). The tumor cells are transfected using techniques described herein) with a sufficient amount of an expression vector, such as e.g., a pMaxVax vector, described in the Example V below, that comprises a NCSM polynucleotide encoding a NCSM polypeptide (full-length) or soluble NCSM-ECD polypeptide (or NCSM-ECD-Ig fusion protein) such that expression results, and in the case of soluble polypeptides, the soluble polypeptides are secreted.

Genetic Vectors

Gene therapy and genetic vaccine vectors are useful for treating and/or preventing various diseases and other conditions. The following discussion focuses on the on the use of vectors because gene therapy and genetic vaccine method typically employ vectors, but persons of skill in the art appreciate that the nucleic acids of the invention can, depending on the particular application, be employed in the absence of vector sequences. Accordingly, references in the following discussion to vectors should be understood as also relating to nucleic acids of the invention that lack vector sequences.

Vectors can be delivered to a subject to induce an immune response or other therapeutic or prophylactic response. Suitable subjects include, but are not limited to, a mammal, including, e.g., a human, primate, monkey, orangutan, baboon, mouse, pig, cow, cat, goat, rabbit, rat, guinea pig, hamster, horse, sheep; or a non-mammalian vertebrate such as a bird (e.g., a chicken or duck) or a fish, or invertebrate.

Vectors can be delivered in vivo by administration to an individual patient, typically by local (direct) administration or by systemic administration (e.g., intravenous, intraperitoneal, intramuscular, subdermal, intracranial, anal, vaginal, oral, buccal route or they can be inhaled) or they can be administered by topical application. Alternatively, vectors can be delivered to cells ex vivo, such as cells explanted from an individual patient (e.g., lymphocytes, bone marrow aspirates, tissue biopsy) or universal donor hematopoietic stem cells, followed by reimplantation of the cells into a patient, usually after selection for cells which have incorporated the vector.

In local (direct) administration formats, the nucleic acid or vector is typically administered or transferred directly to the cells to be treated or to the tissue site of interest (e.g., tumor cells, tumor tissue sample, organ cells, blood cells, cells of the skin, lung, heart, muscle, brain, mucosae, liver, intestine, spleen, stomach, lymphatic system, cervix, vagina, prostate, mouth, tongue, etc.) by any of a variety of formats, including topical administration, injection (e.g., by using a needle or syringe), or vaccine or gene gun delivery, pushing into a tissue, organ, or skin site. For standard gene gun administration, the vector or nucleic acid of interest is precipitated onto the surface of microscopic metal beads. The microprojectiles are accelerated with a shock wave or expanding helium gas, and penetrate tissues to a depth of several cell layers. For example, the AccelTM Gene Delivery Device manufactured by Agacetus, Inc. Middleton Wis. is suitable for use in this embodiment. The nucleic acid or vector can be delivered, for example, intramuscularly, intradermally, subdermally, subcutaneously, orally, intraperitoneally, intrathecally, intravenously, or placed within a cavity of the body (including, e.g., during surgery), or by inhalation or vaginal or rectal administration.

In in vivo indirect contact/administration formats, the nucleic acid or vector is typically administered or transferred indirectly to the cells to be treated or to the tissue site of interest, including those described above (such as, e.g., skin cells, organ systems, lymphatic system, or blood cell system, etc.), by contacting or administering the nucleic acid or vector of the invention directly to one or more cells or population of cells from which treatment can be facilitated. For example, tumor cells within the body of the subject can be treated by contacting cells of the blood or lymphatic system, skin, or an organ with a sufficient amount of the polypeptide such that delivery of the nucleic acid or vector to the site of interest (e.g., tissue, organ, or cells of interest or blood or lymphatic system within the body) occurs and effective prophylactic or therapeutic treatment results. Such contact, administration, or transfer is typically made by using one or more of the routes or modes of administration described above.

A large number of delivery methods are well known to those of skill in the art. Such methods include, for example liposome-based gene delivery (Debs and Zhu (1993) WO 93/24640; Mannino and Gould-Fogerite (1988) *BioTechniques* 6(7):682–691; Rose U.S. Pat No. 5,279,833; Brigham (1991) WO 91/06309; and Felgner et al. (1987) *Proc. Natl Acad. Sci. USA* 84:7413–7414), as well as use of viral vectors (e.g., adenoviral (see, e.g., Berns et al. (1995) *Ann. NY Acad. Sci.* 772:95–104; Ali et al. (1994) *Gene Ther.* 1:367–384; and Haddada et al. (1995) *Curr. Top. Microbiol. Immunol.* 199 (Pt 3):297–306 for review), papillomaviral, retroviral (see, e.g., Buchscher et al. (1992) *J. Virol.* 66(5) 2731–2739; Johann et al. (1992) *J. Virol.* 66 (5):1635–1640 (1992); Sommerfelt et al., (1990) *Virol.* 176:58–59; Wilson et al. (1989) *J. Virol.* 63:2374–2378; Miller et al., *J. Virol.* 65:2220–2224 (1991); Wong-Staal et al., PCT/US94/05700, and Rosenburg and Fauci (1993) in *Fundamental Immunology, Third Edition* Paul (ed) Raven Press, Ltd., New York and the references therein, and Yu et al., *Gene Therapy* (1994) supra.), and adeno-associated viral vectors (see, West et al. (1987) *Virology* 160:38–47; Carter et al. (1989) U.S. Pat. No. 4,797,368; Carter et al. WO 93/24641 (1993); Kotin (1994) *Human Gene Therapy* 5:793–801; Muzyczka (1994) *J. Clin. Invst.* 94:1351 and Samulski (supra) for an overview of AAV vectors; see also, Lebkowski, U.S. Pat. No. 5,173, 414; Tratschin et al. (1985) *Mol. Cell. Biol.* 5(11):3251–3260; Tratschin, et al. (1984) *Mol. Cell. Biol.,* 4:2072–2081; Hermonat and Muzyczka (1984) *Proc. Natl Acad. Sci. USA,* 81:6466–6470; McLaughlin et al. (1988) and Samulski et al. (1989) *J. Virol.,* 63:03822–3828), and the like.

"Naked" DNA and/or RNA that comprises a genetic vaccine can also be introduced directly into a tissue, such as muscle, by injection using a needle or other similar device. See, e.g., U.S. Pat. No. 5,580,859. Other methods such as "biolistic" or particle-mediated transformation (see, e.g., Sanford et al., U.S. Pat. No. 4,945,050; U.S. Pat. No. 5,036,006) are also suitable for introduction of genetic vaccines into cells of a mammal according to the invention. These methods are useful not only for in vivo introduction of DNA into a subject, such as a mammal, but also for ex vivo modification of cells for reintroduction into a mammal. DNA is conveniently introduced directly into the cells of a mammal or other subject using, e.g., injection, such as via a needle, or a "gene gun." As for other methods of delivering genetic vaccines, if necessary, vaccine administration is repeated in order to maintain the desired level of immunomodulation, such as the level or response of T cell activation or T cell proliferation, or antibody titer level. Alternatively, nucleotides can be impressed into the skin of the subject.

Gene therapy and genetic vaccine vectors (e.g., DNA, plasmids, expression vectors, adenoviruses, liposomes, papillomaviruses, retroviruses, etc.) comprising at least one NCSM sequence can be administered directly to the subject (usually a mammal) for transduction of cells in vivo. The vectors can be formulated as pharmaceutical compositions for administration in any suitable manner, including parenteral (e.g., subcutaneous, intramuscular, intradermal, or intravenous), topical, oral, rectal, vaginal, intrathecal, buccal (e.g., sublingual), or local administration, such as by aerosol or transdermally, for immunotherapeutic or other prophylactic and/or therapeutic treatment. Pretreatment of skin, for example, by use of hair-removing agents, may be useful in transdermal delivery. Suitable methods of administering such packaged nucleic acids are available and well known to those of skill in the art, and, although more than one route can be used to administer a particular composition, a particular route can often provide a more immediate and more effective reaction than another route.

Further, the vectors of this invention comprising at least one nucleotide sequence encoding at least one NCSM (and, if desired, further comprising a nucleotide sequence encoding antigen or other co-stimulatory molecule co-expressed on the same vector) can be used to prophylactically or therapeutically treat or supplement such treatment of other immunological disorders and diseases or enhance protection against disorders, diseases, and antigens (including WT and recombinant antigens), e.g., in protein vaccines and DNA vaccines, including, but not limited to, e.g., allergy/asthma, neurological, organ transplantation (e.g., graft versus host disease, and autoimmune diseases), malignant diseases, chronic infectious diseases, including, but not limited to, e.g., viral infectious diseases, such as those associated with, but not limited to, e.g., alpha viruses, hepatitis viruses, e.g., hepatitis B virus (HBV), herpes simplex virus (HSV), hepatitis C virus (HCV), HIV, human papilloma virus (HPV), malaria, Venezuelan equine encephalitis (VEE), Western equine encephalitis (WEE), Japanese encephalitis virus, Eastern equine encephalitis, and the like, and bacterial infectious diseases, such as, e.g., but not limited to, e.g., Lyme disease, tuberculosis, and chlamydia infections; and other diseases and disorders described herein.

If desired, a separate vector comprising a nucleotide sequence encoding an antigen or other co-stimulatory molecule can be delivered simultaneously with a vector comprising a NCSM sequence of the invention.

Compositions and Formulations

The present invention also includes compositions of any NSCM nucleic acid or NCSM polypeptide of the invention. In one aspect, the invention provides therapeutic and/or prophylactic compositions comprising at least one NCSM polypeptide (or fragment thereof) or nucleic acid (or fragment thereof) of the invention, or vectors, transduced cells, or vaccines comprising at least one NCSM nucleic acid or polypeptide (or fragment) of the invention. Such compositions optionally are tested in appropriate in vitro and in vivo animal models of disease, to confirm efficacy, tissue metabolism, and to estimate dosages, according to methods well known in the art. In particular, dosages for therapeutic and prophylactic methods for treating or preventing a disease or condition can be determined by activity comparison of the NCSM molecules to other known therapeutics using similar compositions in a relevant assay and mammalian model, including as described below.

Administration optionally is by any of the routes normally used for introducing a molecule into ultimate contact with blood or tissue cells. See, supra. The NCSM polypeptides and polynucleotides, and vectors, cells, and compositions comprising such molecules, are administered in any suitable manner, preferably with pharmaceutically acceptable carriers. Suitable methods of administering such NCSM molecules, in the context of the present invention, to a patient are available, and, although more than one route can be used to administer a particular composition, a particular route can often provide a more immediate and more effective reaction than another route. Preferred routes are readily ascertained by those of skill in the art.

Compositions comprising cells expressing at least one full length form of a NCSM polypeptide or a fragment thereof (ECD) are also a feature of the invention. Such cells may also express one or more antigens specific for the intended application (e.g., cancer antigen). Such cells are readily prepared as described herein by transfection with DNA plasmid vector encoding at least one of the NCSM polypeptide and/or antigen. Separate vectors each encoding a NCSM polypeptide and antigen may be used to transfect the cells, or a bicistronic vector encoding both the NCSM polypeptide and antigen can be used. Compositions of such cells may be pharmaceutically compositions further comprising a pharmaceutically acceptable carrier or excipient.

Pharmaceutical compositions of the invention can, but need not, include a pharmaceutically acceptable carrier. Pharmaceutically acceptable carriers are determined in part by the particular composition being administered, as well as by the particular method used to administer the composition. Accordingly, there are a wide variety of suitable formulations of pharmaceutical compositions of the present invention. A variety of aqueous carriers can be used, e.g., buffered saline, such as PBS, and the like. These solutions are sterile and generally free of undesirable matter. These compositions may be sterilized by conventional, well known sterilization techniques. The compositions may contain pharmaceutically acceptable auxiliary substances as required to approximate physiological conditions such as pH adjusting and buffering agents, toxicity adjusting agents and the like, for example, sodium acetate, sodium chloride, potassium chloride, calcium chloride, sodium lactate and the like. The concentration of gene therapy or genetic vaccine vector in these formulations can vary widely, and will be selected primarily based on fluid volumes, viscosities, body weight and the like in accordance with the particular mode of administration selected and the patient's needs.

Compositions comprising NCSM polypeptides and polynucleotides, and vectors, cells, and other formulations comprising these and other components of the invention, can be administered by a number of routes including, but not limited to oral, intranasal, intravenous, intraperitoneal, intramuscular, transdermal, subcutaneous, intradermal, topical, sublingual, vaginal, or rectal means. Polypeptide and nucleic acid compositions can also be administered via liposomes. Such administration routes and appropriate formulations are generally known to those of skill in the art.

The NCSM polypeptide or polynucleotide or fragment thereof, or vector comprising a NCSM nucleic acid, alone or in combination with other suitable components, can also be made into aerosol formulations (e.g., they can be "nebulized") to be administered via inhalation. Aerosol formulations can be placed into pressurized acceptable propellants, such as dichlorodifluoromethane, propane, nitrogen, and the like.

Formulations suitable for oral administration can consist of (a) liquid solutions, such as an effective amount of the packaged nucleic acid suspended in diluents, such as water, saline or PEG 400; (b) capsules, sachets or tablets, each containing a predetermined amount of the active ingredient, as liquids, solids, granules or gelatin; (c) suspensions in an appropriate liquid; and (d) suitable emulsions. Tablet forms can include one or more of lactose, sucrose, mannitol, sorbitol, calcium phosphates, corn starch, potato starch, tragacanth, microcrystalline cellulose, acacia, gelatin, colloidal silicon dioxide, croscarmellose sodium, talc, magnesium stearate, stearic acid, and other excipients, colorants, fillers, binders, diluents, buffering agents, moistening agents, preservatives, flavoring agents, dyes, disintegrating agents, and pharmaceutically compatible carriers. Lozenge forms can comprise the active ingredient in a flavor, usually sucrose and acacia or tragacanth, as well as pastilles comprising the active ingredient in an inert base, such as gelatin and glycerin or sucrose and acacia emulsions, gels, and the like containing, in addition to the active ingredient, carriers known in the art. It is recognized that the gene therapy vectors and genetic vaccines, when administered orally, must be protected from digestion. This is typically accomplished either by complexing the vector with a composition to render it resistant to acidic and enzymatic hydrolysis or by packaging the vector in an appropriately resistant carrier such as a liposome. Means of protecting vectors from digestion are well known in the art. The pharmaceutical compositions can be encapsulated, e.g., in liposomes, or in a formulation that provides for slow release of the active ingredient.

The packaged nucleic acids, alone or in combination with other suitable components, can be made into aerosol formulations (e.g., they can be "nebulized") to be administered via inhalation. Aerosol formulations can be placed into pressurized acceptable propellants, such as dichlorodifluoromethane, propane, nitrogen, and the like.

Suitable formulations for rectal administration include, for example, suppositories, which consist of the packaged nucleic acid with a suppository base. Suitable suppository bases include natural or synthetic triglycerides or paraffin hydrocarbons. In addition, it is also possible to use gelatin rectal capsules which consist of a combination of the packaged nucleic acid with a base, including, for example, liquid triglycerides, polyethylene glycols, and paraffin hydrocarbons.

Formulations suitable for parenteral administration, such as, for example, by intraarticular (in the joints), intravenous, intramuscular, intradermal, subdermal, intraperitoneal, and subcutaneous routes, include aqueous and non-aqueous, isotonic sterile injection solutions, which can contain antioxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. In the practice of this invention, compositions can be administered, for example, by intravenous infusion, orally, topically, intraperitoneally, intravesically or intrathecally. The formulations of packaged nucleic acids or polypeptides of the invention can be presented in unit-dose or multi-dose sealed containers, such as ampules and vials.

Parenteral administration and intravenous administration are preferred methods of administration. In particular, any routes of administration already in use for existing co-stimulatory therapeutics and prophylactic treatment protocols, including those currently employed with e.g., mammalian B7-1 polynucleotides and polypeptides, such as hB7-1, along with pharmaceutical compositions and formulations in current use, are preferred routes of administration and formulation for the NCSM polynucleotides or polypeptides (and fragments thereof).

Injection solutions and suspensions can be prepared from sterile powders, granules, and tablets of the kind previously described. Cells transduced by the packaged nucleic acid can also be administered intravenously or parenterally.

Cells transduced with the NCSM nucleic acids as described herein in the context of ex vivo or in vivo therapy can also be administered intravenously or parenterally. It will be appreciated that the delivery of cells to patients is routine, e.g., delivery of cells to the blood via intravenous, intramuscular, or intraperitoneal administration or other common route.

The dose administered to a patient, in the context of the present invention is sufficient to effect a beneficial effect, such as an altered immune response or other therapeutic and/or prophylactic response in the patient over time, or to, e.g., inhibit infection by a pathogen, depending on the application. The dose will be determined by the efficacy of the particular nucleic acid, polypeptide, vector, composition or formulation, transduced cell, cell type, and/or the activity of the NCSM polypeptide and/or polynucleotide included therein or employed, and the condition of the patient, as well as the body weight, surface area, or vascular surface area, of the patient to be treated. The size of the dose also will be determined by the existence, nature, and extent of any adverse side-effects that accompany the administration of any such particular polypeptide, nucleic acid, vector, formulation, composition, transduced cell, cell type, or the like in a particular patient. Dosages to be used for therapeutic or prophylactic treatment of a particular disease or disorder can be determined by one of skill by comparison to those dosages used for existing therapeutic or prophylactic treatment protocols for the same disease or disorder.

Injection solutions and suspensions can be prepared from sterile powders, granules, and tablets of the kind previously described. Cells transduced by the packaged nucleic acid can also be administered intravenously or parenterally.

In determining the effective amount of the vector, cell type, composition, or formulation to be administered to a subject for the treatment or prophylaxis of the medical condition or disease state (e.g., cancers or viral diseases), a physician evaluates the subject for, e.g., circulating plasma levels, vector/cell/formulation/NCSM molecule toxicities, progression of the disease or condition, and the production of anti-vector/NCSM polypeptide antibodies, and depending on the subject other factors that would be known to one of skill in the art.

In one aspect, for example, in determining the effective amount of the vector to be administered in the treatment or prophylaxis of an infection or other condition, wherein the vector comprises any NCSM nucleic acid sequence described herein or encodes any NCSM polypeptide described herein, the physician evaluates vector toxicities, progression of the disease, and the production of anti-vector antibodies, if any. In one aspect, the dose equivalent of a naked nucleic acid from a vector for a typical 70 kilogram patient can range from about 10 ng to about 1 g, about 100 ng to about 100 mg, about 1 µg to about 10 mg, about 10 µg to about 1 mg, or from about 30–300 µg. Doses of vectors used to deliver the nucleic acid are calculated to yield an equivalent amount of therapeutic nucleic acid. Administration can be accomplished via single or divided doses.

In another aspect, the dose administered, e.g., to a 70 kilogram patient can be in the range equivalent to any dosages of currently-used co-stimulatory or WT B7-1 therapeutic or prophylactic proteins (such a hB7-1) or the like, and doses of vectors or cells which produce NCSM sequences optionally are calculated to yield an equivalent amount of NCSM nucleic acid or expressed polypeptide or protein. The vectors of this invention comprising at least one nucleotide sequence encoding at least one NCSM (and, if desired, further comprising a nucleotide sequence encoding antigen or other co-stimulatory molecule either on the same vector) can be used to prophylactically or therapeutically treat or supplement such treatment of a variety of cancers, including e.g., colorectal cancer, breast cancer, pancreatic cancer, lung cancer, prostate cancer, naso-pharyngeal cancer, cancer, brain cancer, leukemia, melanoma, head- and neck cancer, stomach cancer, cervical cancer, ovarian cancer, lymphomas, colon cancer, colorectal, and virally-mediated conditions by any known conventional therapy, including cytotoxic agents, nucleotide analogues (e.g., when used for treatment of HIV infection), biologic response modifiers, and the like.

In therapeutic applications, compositions are administered to a patient suffering from a disease (e.g., an infectious disease, cancer, or autoimmune disorder) in an amount sufficient to cure or at least partially arrest or ameliorate the disease or at least one of its complications. An amount adequate to accomplish this is defined as a "therapeutically effective dose." Amounts effective for this use will depend upon the severity of the disease and the general state of the patient's health. Single or multiple administrations of the compositions may be administered depending on the dosage and frequency as required and tolerated by the patient. In any event, the composition should provide a sufficient quantity of protein to effectively treat the patient.

In prophylactic applications, compositions are administered to a human or other mammal to induce an immune or other prophylactic response that can help protect against the establishment of an infectious disease, cancer, autoimmune disorder, or other condition.

In some applications, an amount of NCSM polypeptide that is administered to a subject for a particular therapeutic or prophylactic treatment protocol or vaccination ranges from about 1 to about 50 mg/kg weight of the subject. Such amount of polypeptide can be administered 1 time/week or up to 3 times/week, as desired. Such NCSM polypeptide can be administered as a soluble molecule comprising, e.g., an NCSM-ECD, or NCSM-trunECD-Ig or NCSM-ECD-Ig fusion protein. Alternatively, such NCSM polypeptide can be administered in the form of a NCSM-polypeptide-encoding polynucleotide, which is operably linked to a promoter, such that the polynucleotide expresses in the subject such a NCSM polypeptide of from about 1 to about 50 mg/kg weight of the subject (e.g., on the surface of targeted cells) or as an expressed soluble NCSM polypeptide. The NCSM polypeptide (or nucleic acid encoding the polypeptide) can be administered to a population of cells of a subject in vivo, or to a population of cells of the subject ex vivo as described herein. Compositions comprising soluble NCSM polypeptides in such range amounts or comprising nucleic acids or expression vectors that can express such amounts in the subject are also contemplated.

The toxicity and therapeutic efficacy of the vectors that include recombinant molecules provided by the invention are determined using standard pharmaceutical procedures in cell cultures or experimental animals. One can determine the $LD_{50}$ (the dose lethal to 50% of the population) and the $ED_{50}$ (the dose therapeutically effective in 50% of the population) using procedures presented herein and those otherwise known to those of skill in the art. Nucleic acids, polypeptides, proteins, fusion proteins, transduced cells and other formulations of the present invention can be administered at a rate determined, e.g., by the $LD_{50}$ of the formulation, and the side-effects thereof at various concentrations, as applied to the mass and overall health of the patient. Again, administration can be accomplished via single or divided doses.

A typical pharmaceutical composition for intravenous administration would be about 0.1 to 10 mg per patient per day. Dosages from 0.1 up to about 100 mg per patient per day may be used, particularly when the drug is administered to a secluded site and not into the blood stream, such as into a body cavity or into a lumen of an organ. Substantially higher dosages are possible in topical administration. For recombinant promoters of the invention that express the linked transgene at high levels, it may be possible to achieve the desired effect using lower doses, e.g., on the order of about 1 µg or 10 µg per patient per day. Actual methods for preparing parenterally administrable compositions will be known or apparent to those skilled in the art and are described in more detail in such publications as *Remington's Pharmaceutical Science,* 15th ed., Mack Publishing Company, Easton, Pa. (1980).

For introduction of recombinant NCSM nucleic acid transduced cells into a patient, an illustrative, but not limiting example includes taking blood samples, obtained prior to infusion, and saved for analysis. Between, e.g., $1 \times 10^6$ and $1 \times 10^{12}$ transduced cells are infused intravenously over, e.g., 60–200 minutes. Vital signs and oxygen saturation by pulse oximetry are closely monitored. Blood samples are obtained, e.g., 5 minutes and, e.g., 1 hour following infusion and saved for subsequent analysis. Leukopheresis, transduction and reinfusion are optionally repeated every, e.g., 2 to 3 months for a total of, e.g., 4 to 6 treatments in a one year period. After the first treatment, infusions can be performed, e.g., on a outpatient basis at the discretion of the clinician. If the reinfusion is given as an outpatient, the participant is monitored for, e.g., at least 4, and preferably, e.g., 8 hours following the therapy. Transduced cells are prepared for reinfusion according to established methods. See, Abrahamsen et al. (1991) *J Clin Apheresis* 6:48–53; Carter et al. (1988) *J Clin Arpheresis* 4:113–117; Aebersold et al. (1988), *J Immunol Methods* 112:1–7; Muul et al. (1987) *J Immunol Methods* 101:171–181 and Carter et al. (1987) *Transfusion* 27:362–365. After a period of, e.g., about 2–4 weeks in culture, the cells should number between, e.g., $1 \times 10^6$ and $1 \times 10^{12}$. In this regard, the growth characteristics of cells vary from patient to patient and from cell type to cell type. About, e.g., 72 hours prior to reinfusion of the transduced cells, an aliquot is taken for analysis of phenotype, and percentage of cells expressing the therapeutic agent.

If a patient undergoing infusion of a vector or transduced cell or protein formulation develops, e.g., fevers, chills, or muscle aches, he/she receives the appropriate dose of, e.g., aspirin, ibuprofen, acetaminophen or other pain/fever controlling drug. Patients who experience reactions to the infusion such as fever, muscle aches, and chills are premedicated, e.g., 30 minutes prior to the future infusions with, e.g., either aspirin, acetaminophen, or, e.g., diphenhydramine, etc. Meperidine is used for more severe chills and muscle aches that do not quickly respond to antipyretics and antihistamines. Cell infusion is, e.g., slowed or discontinued depending upon the severity of the reaction.

The NCSM polypeptides, NCSM nucleic acids, and cells, vectors, transgenic animals, and compositions that include the NCSM molecules of the invention can be packaged in packs, dispenser devices, and kits for administration to a subject, such as a mammal. For example, packs or dispenser devices that contain one or more unit dosage forms are provided. Typically, instructions for administration of the compounds will be provided with the packaging, along with a suitable indication on the label that the compound is suitable for treatment of an indicated condition. For example, the label may state that the active compound within the packaging is useful for treating a particular infectious disease, autoimmune disorder, tumor, or for preventing or treating other diseases or conditions that are mediated by, or potentially susceptible to, a subject's or mammalian immune response.

Any NCSM nucleic acid, polypeptide, protein, fusion protein, or vector or comprising any such NCSM molecule described herein, and any composition comprising at least one NCSM nucleic acid, polypeptide, protein, fusion protein, or vector or cell comprising at least one such NCSM molecule, can be used in any of the methods and applications described herein. In one aspect, the invention provides for the use of any NCSM polypeptide or nucleic acid (or vector or cell comprising a NCSM nucleic acid) or composition thereof as a medicament, or as a vaccine, for the treatment of one of the diseases described herein or for preventing one of the diseases described herein, or the like. In another aspect, the invention provides for the use of any NCSM polypeptide or nucleic acid (or vector or cell comprising a NCSM nucleic acid) or composition thereof for the manufacture of a medicament, or a vaccine, for any therapeutic application relating to treatment of a disease or disorder as described herein. In one aspect, the invention provides methods for modulating or altering a T-cell response specific to an antigen in a subject. Some such methods comprise administering to the subject at least one polynucleotide sequence comprising a NCSM polynucleotide described here (e.g., SEQ ID NOS:1–47,95–173, and 253–262) or at least one polynucleotide encoding a polypeptide comprising any of SEQ ID NOS:48–94, 174–252, 263–272 and 283–293 or fragment thereof, and a polynucleotide sequence encoding the antigen or antigenic fragment thereof. Each of the at least one polynucleotide sequences is expressed in the subject in an amount effective to modulate or alter a T cell response. In some such methods, the polypeptide or fragment thereof interacts with or binds a T cell surface receptor. In some such methods, T-cell response is enhanced as measured by assays described herein, and in some such methods, the enhanced T cell response is sufficient to eliminate cells bearing the antigen or antigenic fragment thereof. In other methods, the T-cell response is suppressed or inhibited as measured by assays described herein.

In some such methods, the antigen or antigenic fragment thereof is an antigen or antigenic fragment thereof of an infectious agent or a cancer. The encoded polypeptide may comprising any NCSM polypeptide of fragment thereof described herein, such as SEQ ID NO:66 or SEQ ID NO:86, or the extracellular domain amino acid sequence of any NCSM polypeptide described herein, or fusion protein thereof.

The at least one polynucleotide sequence encoding a NCSM polypeptide or fragment thereof may be operably linked to a promoter in a vector, such as an expression vector or DNA plasmid. In one aspect, the at least one polynucleotide sequence encoding the antigen or antigenic fragment thereof may be included in the same vector and operably linked to a second promoter in the same vector (e.g., bicistronic vector). Alternatively, the polynucleotide sequences encoding the NCSM polypeptide and the antigen or antigenic fragment are present in separate vectors and administered separately, e.g., either simultaneously or consecutively. The antigen or antigenic fragment thereof may thus be operably linked to a promoter in the second vector.

In another aspect, the invention provides vectors comprising at least one NCSM polynucleotide sequence described herein (e.g, SEQ ID NOS1–47, 95–173, and 253–262) or a polynucleotide sequence encoding a polypeptide comprising any of SEQ ID NOS:48–94, 174–252, 263–272 and 283–293 or fragment thereof, and a polynucleotide sequence encoding the antigen or antigenic fragment thereof, wherein the NCSM polypeptide or fragment thereof interacts with or binds to a T cell receptor when expressed in a subject, and wherein each of the at least one polynucleotide sequences is operably linked to a promoter for expression in the subject and is present in an amount sufficient that when expressed is effective to modulate or alter a T cell response. In some such methods, the at least one polynucleotide sequence encoding a polypeptide comprises a polynucleotide sequence of any of SEQ ID NOS:1–47, 95–173, and 253–262. Each of the at least one polynucleotide sequences may be expressed in the subject in an amount effective to enhance a T cell response such that cells expressing the antigen or antigenic fragment thereof are eliminated. In some methods, each of the at least one polynucleotide sequences is expressed in the subject in an amount effective to inhibit a T cell response.

In another aspect, the invention provides vectors comprising at least one NCSM polynucleotide sequence described herein or at least one polynucleotide sequence encoding a polypeptide comprising any of SEQ ID NOS: 48–94, 174–252, 263–272 and 283–293 or fragment thereof, wherein the polypeptide or fragment thereof interacts with or binds to a T cell receptor when expressed in a subject, wherein the at least one polynucleotide sequence is operably linked to a promoter for expression in the subject and is present in an amount sufficient that when expressed is effective to modulate or alter a T cell response.

In yet another aspect, the invention provides methods of modulating or altering an immune response in a subject, the method comprising introducing into cells of a tumor of the subject at least one polynucleotide sequence encoding a polypeptide comprising any of SEQ ID NOS:48–94, 174–252, 263–272 and 283–293 or fragment thereof, wherein the polypeptide or fragment thereof interacts with or binds to a T cell receptor when expressed in a subject, and wherein the at least one polynucleotide sequence is operably linked to a promoter for expression in the subject and present in an amount sufficient that when expressed is effective to modulate or alter a T cell response.

The invention includes therapeutic methods for activating or enhancing a T-cell response in a subject, wherein the subject may have a tumor or from whom a tumor was surgically removed. Such methods comprise administering to the subject a composition that comprises a polynucleotide sequence encodes a NCSM polypeptide and an excipient, wherein the NCSM polypeptide is expressed by tumor cells or tumor-related cells of the subject, and the T-cell response is activated or enhanced against the tumor. For some such methods, the polynucleotide sequence encodes a soluble NCSM polypeptide. The composition may comprise a vector comprising the polynucleotide sequence that encodes a NCSM polypeptide. Further a therapeutically effective amount of the composition sufficient to enhance a T-cell response against the tumor may be administered. Pharmaceutical composition comprising an expression vector comprising a polynucleotide sequence that encodes a NCSM polypeptide and a pharmaceutically acceptable excipient are also provided.

The invention also includes therapeutic methods for activating or enhancing a T-cell response in a subject who has a tumor or from whom a tumor was removed surgically, the method comprising administering to the subject a composition that comprises a soluble NCSM polypeptide and an excipient, wherein the T-cell response is activated or enhanced against the tumor. Also included are methods for activating or enhancing a T-cell response in such a subject, the methods comprising administering to the subject a sufficient amount of a composition comprising an excipient and a population of cells expressing a NCSM polypeptide and an antigen, such that the T-cell response is thereby activated or enhanced against the tumor. Also contemplated are methods for activating or enhancing a T-cell response in such a subject, the method comprising administering to the subject a sufficient amount of a composition comprising an excipient and a population of cells expressing a NCSM polypeptide, such that the T-cell response is thereby activated or enhanced against the tumor.

Uses and Applications

The evolved novel NCSM molecules of the invention, in all formats described herein, e.g., NCSM nucleic acids, NCSM polypeptides, and vectors, cells, compositions including such NCSM molecules, are useful in a broad range of clinical, therapeutic, and prophylactic applications. Optionally, the polypeptides alone or fragments thereof are used to enhance the immune system (e.g., NCSM polypeptides or soluble NCSM polypeptides (e.g., ECD), NCSM fusion proteins (e.g., comprising an NCSM-ECD fused to an Ig)). For example, these molecules are useful in enhancing tumor immunity and as DNA vaccine adjuvants in combination with, e.g., antigens for specific diseases. They are also useful in the treatment of a variety of medical conditions, including, e.g., chronic infectious diseases, allergies, autoimmune diseases, and in organ transplantation and the reversal of septic shock. Moreover, transgenic animals, such as pigs, mice, etc., expressing CD28BP and/or CTLA-4BP can be generated using methods known to those skilled in the art. Proteins, tissues or organs from such animals can be used to modulate T cell responses in patients undergoing tissue or organ transplantation.

Furthermore, NCSM molecules, such as the CD28BP and CTLA-4BP molecules described herein, are useful as components in multi-component vaccines, which optionally comprise, e.g., a single vector with multiple components or multiple vectors encoding different vector components. A multi-component vaccine optionally comprises, e.g., a vector, such as a DNA plasmid vector, that comprises, for example, in addition to nucleotide sequences encoding one or more CD28BP and/or CTLA-4BP polypeptides, one or more nucleotide sequences encoding at least of the following components: at least one antigen(s), cytokine(s), adjuvant(s), promoter (e.g., wild-type CMV promoter (such as human CMV promoter with or without an intron A sequence; or a recombinant, or chimeric CMV promoter with or without a recombinant or WT intron A sequence), and/or other co-stimulatory molecule(s) (each of which may have been optimized by recursive sequence recombination and selection/screening procedures, random mutagenesis, or other known mutagenesis procedures), and combinations of such various components. Such multi-component vector expresses two or more such components and includes appropriate expression elements for such expression (see, e.g., an exemplary multi-component vector described in Example V). Such an arrangement permits co-delivery of various components, including recursively recombined components, for a particular treatment regimen or therapeutic or prophylactic application. Such vectors are designed according to the specific treatment regimen or therapeutic or prophylactic application desired. One or more such single-component or multi-component vector as described above may be used simultaneously or in sequential administration in a therapeutic or prophylactic treatment method of the invention.

Also, an immune response is optionally modified or enhanced by, e.g., administering one or more nucleic acids encoding one or more novel CD28BPs (or fragments thereof, including, e.g., soluble CD28BPs or fusion proteins thereof) or CTLA-4BPs (or fragments thereof, including, e.g., soluble CTLA-4BPs or fusion proteins thereof) with an antigen. Alternatively, an antigen response is optionally enhanced or modified by administration of one or more CD28BPs (or fragments thereof, including, e.g., soluble CD28BPs) or CTLA4-BPs (or fragments thereof, including, e.g., soluble CTLA-4BPs) with an antigen.

CD28BPs and CTLA-4BPs are useful in modulating the immune response in vivo in a variety of animals, (e.g., mammals, (including humans)) and in vitro. These molecules are particularly useful in therapeutic and/or prophylactic applications when modulation of T cell responses is desired. Examples of useful applications for CD28BP and/or CTLA4BP (or fragments thereof of each, or soluble and/or fusion protein versions of each) include conditions or diseases that may benefit from enhanced T cell responses or where enhanced T cell responses are desired. They are also useful, for example, in treating diseases where inhibition of T cell proliferation/activation is desired. Examples of medical conditions and/or diseases where enhanced T cell response is desired (e.g., by use of CD28BPs) (or fragments thereof, soluble and/or fusion protein versions) include, for example, cancer, chronic infectious diseases, and vaccinations. Cancers include, but are not limited to, e.g., colorectal cancer, breast cancer, pancreatic cancer, lung cancer, prostate cancer, naso-pharyngeal cancer, cancer, brain cancer, leukemia, melanoma, head- and neck cancer, stomach cancer, cervical cancer, ovarian cancer, and lymphomas.

CD28BPs and CTLA-4BPs are useful in a variety of therapeutic and prophylactic treatment of diseases and conditions, including, e.g., allergy/asthma, neurological, organ transplantation (e.g., graft versus host disease, and autoimmune diseases), malignant diseases, chronic infectious diseases, including, but not limited to, e.g., viral infectious diseases, such as those associated with, but not limited to, e.g., hepatitis B virus (HBV), herpes simplex virus (HSV), hepatitis C virus (HCV), HIV, human papilloma virus (HPV), and the like, and bacterial infectious diseases, such as, but not limited to, e.g., Lyme disease, tuberculosis, and chlamydia infections, and the like.

Furthermore, CD28BPs and CTLA-4BPs are useful in methods for modulating production of specific cytokines, including those discussed in the Examples below. These molecules are particularly useful in therapeutic and/or prophylactic applications in which an adjustment, alteration of a cytokine level, or production or stimulation of a specific cytokine production is desired.

CD28BP polypeptides of the invention, or fragments thereof or soluble and/or fusion proteins thereof, modulate T cell proliferation or activation and augment the immune response. In one embodiment, such a CD28BP polypeptide can be delivered in a treatment protocol as a component of a DNA vaccine vector, as a full-length polypeptide, as a soluble polypeptide subsequence of the full-length CD28BP polypeptide (e.g., ECD) used, if desired, as a polypeptide or protein vaccine or "boosting" polypeptide, or as a soluble fusion protein comprising a full-length CD28BP polypeptide or subsequence thereof, such as a soluble polypeptide subsequence (e.g., ECD); in such formats, the CD28BP polypeptide may act as an agonist. In another embodiment, such as a genetic vaccine, in combination with a nucleic acid sequence encoding a specific antigen, a nucleic acid sequence encoding a CD28BP polypeptide augments the antigen specific T cell response for infectious disease or cancer antigens.

The CTLA4BPs, or fragments thereof or soluble and/or fusion proteins thereof, of the invention can modulate T cell proliferation and/or activation and inhibit the immune response in autoimmune diseases or, as soluble molecules, act as antagonists. Such a CTLA-4BP polypeptide can be delivered in a treatment protocol as a component of a DNA vaccine vector, as a full-length polypeptide, as a soluble polypeptide subsequence of the full-length CTLA-4BP polypeptide (e.g., ECD) used, if desired, as a polypeptide or protein vaccine or "boosting" polypeptide, or as a soluble fusion protein comprising a full-length CTLA-4BP polypeptide or subsequence thereof, such as a soluble polypeptide subsequence (e.g., ECD); in such formats, the CTLA-4BP polypeptide may serve as an agonist.

As discussed above, genetic vaccine comprising a vector comprising a nucleic acid sequence encoding a CTLA4-BP polypeptide and at least one nucleic acid sequence encoding at least one additional polypeptide of interest is also a feature of the invention. For example, in a DNA vaccine, in combination with a specific allergen, the CTLA4BPs (or fragments thereof, or soluble and/or fusion proteins thereof) may inhibit the allergen specific T cell response in allergy. Similarly, in combination with a specific auto-antigen, such as myelin basic protein, the CTLA-4BPs (or fragments thereof, or soluble and/or fusion proteins thereof) may inhibit the auto-antigen-specific T cell response in autoimmunity, such as in multiple sclerosis.

Other clinical applications in which inducing tolerance is important and thus in which CTLA-4BPs are of use include autoimmunity (e.g., multiple sclerosis, rheumatoid arthritis, psoriasis), severe allergy and asthma, organ transplantation, generation of transgenic tissues to enable xenotransplants, graft versus host disease, and with components of gene therapy vectors to prolong survival of cells expressing foreign proteins.

Examples of medical conditions and/or diseases where down-regulation, or other altered type of T cell function by delivery of a CTLA-4BP of the invention either as a DNA expression vector comprising a nucleic acid sequence encoding a CTLA-4BP polypeptide or as a soluble described herein), or fragments thereof or soluble and/or fusion proteins thereof, may be of benefit include allergy, undesired immune response, autoimmune diseases, septic shock, and organ transplantation.

Examples of useful pathogen antigens, cancer antigens, allergens and auto-antigens for use in methods of the invention and/or in combination with NCSM polypeptides have been provided in the following commonly assigned patent applications: Punnonen et al. (1999) WO 99/41369; Punnonen et al. (1999) WO 99/41383; Punnonen et al. (1999) WO 99/41368; and Punnonen et al. (1999) WO 99/41402), each of which is incorporated herein by reference in its entirety for all purposes. Several other useful antigens have been described in the literature or can be discovered using genomics approaches. Since typical tumor antigens are self proteins and thus host tolerant, it is optionally necessary to generate "non-self" tumor antigens that induce cross-reactivity against self tumor antigens also. This is optionally accomplished through, e.g., recursive sequence recombination of existing tumor antigens from diverse species to produce chimeric tumor antigens. Such chimeric antigens are then screened for ones which activate antigen-specific T cells which also recognize the wild-type tumor antigen. Optional screenings test whether chimeric antigens activate patient T cells (e.g., T cell lines specific for wild-type antigens generated and activation induced by APCs expressing recursively recombined antigens analyzed) and whether the chimeric antigen induces T cells that recognize wild-type antigen (e.g., T cell lines specific for recursively recombined antigens generated and activation induced by APCs expressing WT antigen analyzed).

A NCSM polypeptide of the invention is also useful in therapeutic or prophylactic treatment methods for treating or preventing any of the above-mentioned diseases and disorders when administered to a subject as a polypeptide (e.g., administer at least one full-length or soluble NCSM or fragment thereof) or cell-based vaccine (e.g., cell expressing or secreting at least one NCSM polypeptide) or a gene-based therapeutic polypeptide (i.e., polypeptide product expressed by a NCSM gene), wherein such NSMC polypeptides are delivered alone or co-administered simultaneously or subsequently with one or more of an antigen, another co-stimulatory molecule, or adjuvant. A NCSM molecule is also useful for treating or preventing any of the above-mentioned diseases and disorders when administered to a subject as a genetic vaccine (e.g., DNA vaccine) in which at least one NCSM polynucleotide is administered alone or in a plasmid vector or gene therapy format (i.e., a vector encoding at least one NCSM polypeptide). Or, if desired, at least one NCSM polynucleotide is co-administered with a second DNA vector encoding at least one of an antigen, co-stimulatory molecule, and/or adjuvant. Alternatively, if desired, a vector comprising at least one NCSM-encoding polynucleotide sequence and at least one of an antigen, co-stimulatory molecule, and/or adjuvant can be prepared and administered to a subject in a treatment protocol; in this instance, the at least one NCSM-encoding polynucleotide is co-expressed with at least one antigen, co-stimulatory molecule, and/or adjuvant.

In another aspect, a soluble NCSM polypeptide may be used in methods for treating or preventing any of the above-mentioned diseases or disorders when administered to a subject alone or in conjunction simultaneously or subsequently with one or more of an antigen, another co-stimulatory, and/or adjuvant. The soluble NCSM may comprise a NCSM-ECD or subsequence thereof or may be formulated as a soluble fusion protein. Further, a NCSM polynucleotide that encodes a NSCM or any soluble form of a NCSM as described herein is useful in therapeutic or prophylactic treatment methods for treating or preventing any of the above-mentioned diseases or disorders when administered to a subject alone or in conjunction (simultaneously or subsequently) with one or more nucleotide sequences encoding one or more of an antigen, another co-stimulatory, and/or adjuvant. If desired, the NCSM polynucleotide sequence and one or more polynucleotide sequences encoding one or more of an antigen, another co-stimulatory, and/or adjuvant may be incorporated into one vector for delivery to the subject and co-expression of the resulting NCSM polypeptide, antigen, another co-stimulatory, and/or adjuvant.

As noted above, a variety of antigens can be delivered simultaneously with or following delivery of a NCSM molecule, where the NCSM molecule is administered to the subject in either polypeptide or nucleic acid format. The antigen may be delivered as a polypeptide or polynucleotide (via a vector). Antigens may be WT antigens or recombinant or chimeric antigens, including, e.g., shuffled or mutated antigens.

Examples of cancer antigens that be used with NCSM molecules and in methods of the invention described herein include, e.g., EpCam/KSA, bullous pemphigoid antigen 2, prostate mucin antigen (PMA) (Beckett and Wright (1995) *Int. J. Cancer* 62:703–710), tumor associated Thomsen-Friedenreich antigen (Dahlenborg et al. (1997) *Int. J. Cancer* 70:63–71), prostate-specific antigen (PSA) (Dannull and Belldegrun (1997) *Br. J. Urol.* 1:97–103), luminal epithelial antigen (LEA.135) of breast carcinoma and bladder transitional cell carcinoma (TCC) (Jones et al. (1997) *Anticancer Res.* 17:685–687), cancer-associated serum antigen (CASA) and cancer antigen 125 (CA 125) (Kierkegaard et al. (1995) *Gynecol. Oncol.* 59:251–254), the epithelial glycoprotein 40 (EGP40) (Kievit et al. (1997) *Intl. J. Cancer* 71:237–245), squamous cell carcinoma antigen (SCC) (Lozza et al. (1997) *Anticancer Res.* 17: 525–529), cathepsin E (Mota et al. (1997) *Am. J. Pathol.* 150:1223–1229), tyrosinase in melanoma (Fishman et al. (1997) *Cancer* 79: 1461–1464), cell nuclear antigen (PCNA) of cerebral cavernomas (Notelet et al. (1997) *Surg. Neurol.* 47: 364–370), DF3/MUC1 breast cancer antigen (Apostolopoulos et al. (1996) *Immunol. Cell. Biol.* 74: 457–464; Pandey et al. (1995) *Cancer Res.* 55: 4000–4003), carcinoembryonic antigen (Paone et al. (1996) *J. Cancer Res. Clin. Oncol.* 122:499–503; Schlom et al. (1996) *Breast Cancer Res. Treat.* 38:27–39), tumor-associated antigen CA 19–9 (Tolliver and O'Brien (1997) *South Med. J.* 90:89–90; Tsuruta et al. (1997) *Urol. Intl.* 58:20–24), human melanoma antigens MART-1/Melan-A27–35 and gp100 (Kawakami and Rosenberg (1997) *Intl. Rev. Immunol.* 14:173–192; Zajac et al. (1997) *Intl. J. Cancer* 71:491–496), the T and Tn pancarcinoma (CA) glycopeptide epitopes (Springer (1995) *Crit. Rev. Oncog.* 6:57–85), a 35 kD tumor-associated autoantigen in papillary thyroid carcinoma (Lucas et al. (1996) *Anticancer Res.* 16:2493–2496), KH-1 adenocarcinoma antigen (Deshpande and Danishefsky (1997) *Nature* 387:164–166), the A60 mycobacterial antigen (Maes et al. (1996) *J. Cancer Res. Clin. Oncol.* 122: 296–300), heat shock proteins (HSPs) (Blachere and Srivastava (1995) *Semin. Cancer Biol.* 6:349–355), and MAGE, tyrosinase, melan-A and gp75 and mutant oncogene products (e.g., p53, ras, CDk4, and HER-2/neu (Bueler and Mulligan (1996) *Mol. Med.* 2:545–555; Lewis and Houghton (1995) *Semin. Cancer Biol.* 6: 321–327; Theobald et al. (1995) *Proc. Nat'l. Acad. Sci. USA* 92: 11993–11997), prostate specific membrane antigen (PSMA) Bangma CH et al. (2000) *Microsc Res Tech* 51:430–5, TAG-72, McGuinness RP et al. *Hum Gene Ther* (1999) 10:165–73, and variants, derivatives, and mutated, and recombinant forms (e.g., shuffled forms) thereof of these antigens.

To generate, e.g., vaccines with evolved NCSM molecules, pre-clinical studies can first be done in, e.g., mice. Mice can be used for study of, e.g., CTLA-4BPs because, e.g., effects of the protein are more difficult to study in vitro, work in monkeys is less cost effective than work with mice, mouse models of autoimmune diseases have been established giving excellent means to study induction and breaking tolerance, and the same mouse models can be used for biological characterization of CD28BPs as well. Pre-clinical mice studies can allow optimization of, e.g., vectors for specific targets of interest, pharmacokinetics, drug half life, adjuvant stability and in vivo efficacy of such things as DNA vaccines and soluble protein administration. Mouse studies optionally can be followed by pre-clinical studies in non-human primates. Non-human primate trials can, e.g., optimize efficacy in boosting the innate immune system as well as optimize efficacy of use of NCSM molecules as vaccine adjuvants. Non-human primate trials optionally can serve to, e.g., optimize protective immunity and thereby help identify the best vaccine for human clinical trials.

As an illustrative, but not limiting example, either or both types of NCSM (i.e., CD28BPs and CTLA-4BPs) or fragments thereof can be used in a boosting method or format to modify an immune response. This method would typically comprise, e.g., initially administering a DNA vaccine (a "prime boost") to a subject, followed by, e.g., a second administration with, e.g., one or more of the NCSM polypeptide molecules either in polypeptide format or in nucleic acid format.

Furthermore, the invention also provides for gene therapy vectors comprising at least one nucleotide sequence encoding at least one CTLA-4BP or fragment, variant or homologue thereof. In one aspect, a gene therapy vector (e.g., adenovirus (AV), adeno-associated virus (AAV), retrovirus, poxvirus, or lentivirus vectors) comprising at least one nucleic acid sequence encoding at least one CTLA-4BP polypeptide or fragment thereof) is used to reduce recognition of the transduced cells by specific T cells. The incorporation of the CTLA-4BP-encoding nucleic acid sequence helps to prolong survival of the gene therapy vector. In gene therapy, when the therapeutic or prophylactic transgene is expressed by the host cells, these cells are often also recognized by the cells of the immune system and cytotoxic T cells may destroy the cells expressing the transgene, thereby limiting the efficacy of gene therapy. If the cells expressing the transgene simultaneously express a CTLA-4BP, this will reduce the activity of those cytotoxic T cells, thereby prolonging the survival of the transduced cells and improving the efficacy of gene therapy.

The present invention additionally provides a method to design or identify small molecule agonists and antagonists that either enhance or inhibit signaling through CD28 and/or CTLA-4 molecules. Methods known to those skilled in the art, such as X-ray crystallography, are used to identify the 3-dimensional structures of proteins (i.e., the CD28BPs and CTLA-4BPs of the invention) and fragments thereof of each. These and other methods can be used to identify and determine the conformations and structures that contribute to the preferential binding of the NMCS molecules (e.g., CD28BPs and CTLA-4BPs) of the invention to CD28 and CTLA-4. Based on the information obtained, small molecules that specifically bind to CD28 or CTLA-4 can be designed. Functional screening assays known to those skilled in the art, such as in vitro T cell proliferation/activation assays, can be used to analyze whether such molecules are specific antagonists or agonists. The resulting small molecules that are agonists for CD28 and/or antagonists for CTLA-4 can be used to, e.g., enhance or modify T cell dependent immune responses. Similarly, small molecules that are antagonists for CD28 and/or agonists for CTLA-4 can be used to, e.g., down-regulate or modify T cell specific immune responses and/or to induce tolerance and/or anergy. These various types of small molecules optionally are beneficial as, e.g., vaccine adjuvants and, e.g., in treating diseases when manipulation of T cell response is desired.

The invention includes methods of designing or identifying CD28 agonists that enhance or inhibit signaling through either CD28 or CTLA-4 molecules of T-cells, based on visual viewing and/or analysis of the three-dimensional structure (e.g., X-ray crystallography), an analysis of the residues involved in CD28 and/or CTLA-4 binding, and the positions and types of such residues of any of the polypeptides of the invention as found in SEQ ID NOS:48–94, 174–252, 263–272, 283–293, or fragments thereof.

The invention also includes methods of treating a disease or disorder in a subject in need of such treatment, comprising: administering to the subject any NCSM polypeptide described herein in an amount effective to treat said disease or disorder. In another aspect, the invention provides methods for therapeutic or prophylactic treatment of a disease or disorder in a subject in need of such treatment, comprising: administering to the subject any NCSM polypeptide and an immunogen specific for said disease or disorder, wherein the combined amount of polypeptide and immunogen is effective to prophylactically or therapeutically treat said disease or disorder. In some such methods, the polypeptide is present in an amount sufficient to enhance, diminish or modify an immune response induced by the immunogen. The composition may comprise the polypeptide, the immunogen, and a pharmaceutically acceptable excipient is administered to the subject in an amount effective to treat the disease or disorder. For all such methods, the subject may be a mammal, including, e.g. a human. Further, for some such methods, the polypeptide is administered in vivo to the subject or ex vivo to a population of cells obtained from the subject. In another aspect, the invention includes methods for treating a disease or disorder described herein in a subject in need of such treatment, comprising administering to the subject a NCSM polypeptide in an amount effective to treat the disease or disorder.

The invention includes methods of designing or identifying CD28 agonists that enhance or inhibit signaling through either CD28 or CTLA-4 molecules of T-cells, based on visual viewing and/or analysis of the three-dimensional structure (e.g., X-ray crystallography), an analysis of the residues involved in CD28 and/or CTLA-4 binding, and the positions and types of such residues of any of the polypeptides of the invention as found in SEQ ID NOS:48–94, 174–252, 263–272, 283–293, or fragments thereof.

Integrated Systems

The present invention provides computers, computer readable media, and integrated systems comprising character strings corresponding to the sequence information herein for the polypeptides and nucleic acids herein, including, e.g., those sequences listed herein and various silent substitutions and conservative substitutions thereof. Various methods and genetic algorithms (GAs) known in the art can be used to detect homology or similarity between different character strings, or can be used to perform other desirable functions such as to control output files, provide the basis for making presentations of information including the sequences and the like. Examples include BLAST, discussed supra.

Thus, different types of homology and similarity of various stringency and length can be detected and recognized in the integrated systems herein. For example, many homology determination methods have been designed for comparative analysis of sequences of biopolymers, for spell-checking in word processing, and for data retrieval from various databases. With an understanding of double-helix pair-wise complement interactions among 4 principal nucleobases in natural polynucleotides, models that simulate annealing of complementary homologous polynucleotide strings can also be used as a foundation of sequence alignment or other operations typically performed on the character strings corresponding to the sequences herein (e.g., word-processing manipulations, construction of figures comprising sequence or subsequence character strings, output tables, etc.). An example of a software package with GAs for calculating sequence similarity is BLAST, which can be adapted to the present invention by inputting character strings corresponding to the sequences herein.

Similarly, standard desktop applications such as word processing software (e.g., Microsoft Word™ or Corel WordPerfect™) and database software (e.g., spreadsheet software such as Microsoft Excel™, Corel Quattro Pro™, or database programs such as Microsoft Access™ or Paradox™) can be adapted to the present invention by inputting a character string corresponding to the NCSM polypeptides or polynucleotides of the invention or both, or fragments of either. For example, the integrated systems can include the foregoing software having the appropriate character string information, e.g., used in conjunction with a user interface (e.g., a GUI in a standard operating system such as a Windows, Macintosh or LINUX system) to manipulate strings of characters. As noted, specialized alignment programs such as BLAST can also be incorporated into the systems of the invention for alignment of nucleic acids or proteins (or corresponding character strings).

Integrated systems for analysis in the present invention typically include a digital computer with GA software for aligning sequences, as well as data sets entered into the software system comprising any of the sequences described herein. The computer can be, e.g., a PC (Intel x86 or Pentium chip—compatible DOS™, OS2™ WINDOWS™ WINDOWS NT™, WINDOWS95™, WINDOWS98™ LINUX based machine, a MACINTOSH™, Power PC, or a UNIX based (e.g., SUN™ work station) machine) or other commercially common computer which is known to one of skill. Software for aligning or otherwise manipulating sequences is available, or can easily be constructed by one of skill using a standard programming language such as Visualbasic, Fortran, Basic, Java, or the like.

Any controller or computer optionally includes a monitor which is often a cathode ray tube ("CRT") display, a flat panel display (e.g., active matrix liquid crystal display, liquid crystal display), or others. Computer circuitry is often placed in a box which includes numerous integrated circuit chips, such as a microprocessor, memory, interface circuits, and others. The box also optionally includes a hard disk drive, a floppy disk drive, a high capacity removable drive such as a writeable CD-ROM, and other common peripheral elements. Inputting devices such as a keyboard or mouse optionally provide for input from a user and for user selection of sequences to be compared or otherwise manipulated in the relevant computer system.

The computer typically includes appropriate software for receiving user instructions, either in the form of user input into a set parameter fields, e.g., in a GUI, or in the form of preprogrammed instructions, e.g., preprogrammed for a variety of different specific operations. The software then converts these instructions to appropriate language for instructing the operation of the fluid direction and transport controller to carry out the desired operation.

The software can also include output elements for controlling nucleic acid synthesis (e.g., based upon a sequence or an alignment of a sequence herein) or other operations which occur downstream from an alignment or other operation performed using a character string corresponding to a sequence herein.

The invention provides a computer or computer readable medium comprising a database comprising a sequence record comprising one or more character string corresponding to a nucleic acid or protein sequence selected from SEQ ID NOS:1–272 and 283–293.

In another aspect, the invention provides an integrated system comprising a computer or computer readable medium comprising a database comprising at least one sequence record, each comprising at least one character string corresponding to a nucleic acid or protein sequence selected from SEQ ID NOS:1–272 and 283–293, the integrated system further comprising a user input interface allowing a user to selectively view one or more sequence records. For some such integrated systems, the computer or computer readable medium comprising an alignment instruction set which aligns the character strings with at least one additional character string corresponding to a nucleic acid or protein sequence. The instruction set may comprise one or more of: a local homology comparison determination, a homology alignment determination, a search for similarity determination, and a BLAST determination. Some such systems may further comprise a user readable output element which displays an alignment produced by the alignment instruction set.

In some aspects, the computer or computer readable medium further comprises an instruction set which translates at least one nucleic acid sequence comprising a sequence selected from SEQ ID NOS:1–47, 95–173, and 253–262 into an amino acid sequence. In other aspects, the computer or computer readable medium further comprising an instruction set for reverse-translating at least one amino acid sequence comprising a sequence selected from SEQ ID NOS:48–94, 174–252, 263–272, and 283–293, into a nucleic acid sequence. For some such systems, the instruction set selects the nucleic acid sequence by applying a codon usage instruction set or an instruction set which determines sequence identity to a test nucleic acid sequence.

Also provided is a method of using a computer system to present information pertaining to at least one of a plurality of sequence records stored in a database, each of said sequence records each comprising at least one character string corresponding to SEQ ID NOS:1–272 and 283–293, the method comprising: determining a list of one ore more character strings corresponding to one or more of SEQ ID NOS:1–272 and 283–293, or a subsequence thereof; determining which one ore more character strings of said list are selected by a user; and displaying the selected character strings, or aligning the selected character strings with an additional character string. Some such methods further comprise displaying an alignment of the selected character string with the additional character string and/or displaying the list.

Kits

The present invention also provides kits including the NCSM polypeptides, polynucleotides, expression vectors, cells, vaccines, methods, compositions, systems, and apparatuses of the invention. Kits of the invention optionally comprise at least one of the following of the invention: (1) an apparatus, system, system component, or apparatus component as described herein; (2) at least one kit component comprising a NCSM polypeptide or polynucleotide, soluble NCSM polypeptide or polynucleotide, or fragment thereof; an NCSM-Ig or NCSM-ECD-Ig fusion protein; plasmid expression vector encoding a NCSM polypeptide, soluble NCSM polypeptide, or fragment thereof; cell expressing a NCSM polypeptide, soluble NCSM polypeptide, or fragment thereof; a composition or vaccine composition comprising at least one of any such component; (3) instructions for practicing any method described herein, including a therapeutic or prophylactic methods, instructions for using any component identified in (2) or any vaccine or composition of any such component; and/or instructions for operating any apparatus, system or component described herein; (4) a container for holding said at least one such component or composition, and (5) packaging materials.

In a further aspect, the present invention provides for the use of any apparatus, component, composition, or kit described above and herein, for the practice of any method or assay described herein, and/or for the use of any apparatus, component, composition, or kit to practice any assay or method described herein.

EXAMPLES

The following examples are offered to illustrate the present invention, but not to limit the spirit or scope of the present invention in any way.

Materials and Methods

A. Isolation of Mammalian Parental cDNAs for Library Construction.

Human, rhesus monkey, baboon, orangutan, cow (GenBank Acc. No. Y09950), cat, and rabbit (GenBank Acc. No. D49843) wild-type B7-1 (CD80) parental genes were cloned by the reverse transcriptase polymerase chain reaction (RT-PCR) method. RAJI, PUTI, LCL8664, and 26CB-1 cell lines were used as sources of total or messenger RNA (mRNA) for human (*Homo sapiens*), orangutan (*Pongo pygmaeous*), rhesus monkey (*Macaca mulatta*)(GenBank Acc. No. U19840) and baboon (*Papio hamadryas*) B7-1 genes for B7-1 cDNA preparation. mRNA or total RNA encoding feline (*Felis catus*), bovine (*Bos taurus*) and rabbit (*Oryctolagus cuniculus* sub-species domesticus) B7-1 genes for B7-1 cDNA preparation were obtained from peripheral blood mononuclear cells (PBMCs) derived from the respective species. PBMCs were isolated from cat, cow, and rabbit intravenous blood draws by Ficoll gradient separation. The cells were then activated for 2 days in Dulbecco's modified Eagle's medium (DMEM) containing 10% fetal calf serum (HyClone, Logan, Utah), 5 microgram/milliliter (ug/ml) lipopolysaccharides (LPS), 0.25·g/ml pokeweed mitogen (PWM) and 0.1·g/ml phytohemagglutinin (PHA). Cell lines were maintained at 37° C. in DMEM containing 10% fetal calf serum.

The cell lines or activated PBMCs were harvested and mRNA or total RNA was isolated using FastTrack® 2.0 mRNA Isolation Kit (Invitrogen, Carlsbad, Calif.) or Promega RNAgents® Total RNA Isolation System Kit (Promega, Madison, Wis.), respectively. Primers used to clone the respective mammalian B7-1 cDNAs were designed based on published sequences for human, bovine and rabbit B7-1 genes (see, e.g., Freeman, G. J. et al. (1989) *J Immunol* 143:2714–22; Parsons, K. R. & Howard, C. J. (1999) *Immunogenetics* 49:231–4; and Isono, T. & Seto, A. (1995) *Immunogenetics* 42:217–20)(see also, for human B7-1, GenBank Access. Nos. U33208, AF024703; Cow B7-1, GenBank Acc. No. Y09950; rabbit B7-1, GenBank Access. No. D49843. The primers, which were purchased from Gibco BRL, contained a Bam H I site 5' of the start codon and a Kpn I site 3' of the stop codons. cDNA was generated using the mRNA or total RNA in the Invitrogen cDNA Cycle® Kit. The cDNAs were generated by RT-PCR, which was performed using the cDNA Cycle® kit (Invitrogen, Carlsbad, Calif.) according to the manufacturer's instructions and standard techniques. Each cDNA was then used as a template for PCR generation of, e.g., double-stranded cDNA using primer(s) specific for each species.

All primers used to clone B&-1 (CD80) cDNAs contained a Bam HI site 5' of the species start codon and a Kpn I site 3' of the species stop codons. The PCR products were gel purified using the Bio101 GENECLEAN II kit, digested with BamHI and Kpn I or Asp 718, and ligated into a pcDNA3.1(−) expression vector (Invitrogen, Carlsbad, Calif.) digested with BamHI and Kpn I or Asp 718. The Life Technologies *E. coli* strain DH10B was transformed with the cDNA clones; colonies were picked, grown, and the clones were isolated from the bacteria using the Qiagen Plasmid Maxi kit (Qiagen, Valencia, Calif.).

B. Generation of Recombinant Nucleic Acid Libraries.

Recombinant libraries comprising recombinant (chimeric) nucleic acid sequences were generated by recursive sequence recombination procedures using the seven mammalian cDNAs isolated as described above. In one aspect, libraries comprising shuffled chimeric nucleic acid sequences were generated by applying DNA shuffling procedures to the seven mammalian cDNA sequences as described previously in, e.g., Stemmer, W. (1994) *Nature* 370:389–391 (1994) and Crameri, A. et al. (1998) *Nature* 391:288–91, and other references cited above in the section describing recursive sequence recombination and shuffling methods. The shuffled nucleotide sequences were digested with Bam HI and Asp 718 and gel purified using standard techniques. The resulting chimeric shuffled nucleotide sequences were cloned into a pcDNA3.1⁻ expression vector (Invitrogen, Carlsbad, Calif.) using standard cloning techniques (see, e.g., Sambrook, supra) and according to manufacturer's instructions. The vector was used for transfecting cells as described below.

The FLAG sequence (DYKDDDDK) was inserted at the junction separating the sequence encoding the signal peptide and the sequence encoding the mature polypeptide (e.g., mature coding region) for each of the human B7-1 and CD28BP clones (e.g., CD28BP-15) using the ExSite PCR site-directed mutagenesis kit (Stratagene, San Diego, Calif.) according to manufacturer's instructions. The nucleotide sequences corresponding to the signal sequence and mature coding region were determined for each shuffled nucleotide sequence by comparison with the known sequences corresponding to the signal sequence and mature coding region for hB7-1. Mutagenesis primers were designed with the FLAG sequence flanked by 24 nucleotides of signal and mature coding sequence specific to each clone. Plasmid DNA was prepared and purified from the cDNA libraries following standard procedure in Maniatis et al., *Molecular Cloning: A laboratory Manual*, Cold Spring Harbor, N.Y. (1987).

C. Protein Conjugation.

Soluble CD28-Ig (sCD28-Ig) is a soluble fusion protein between the extracellular domain of human CD28 and the Fc portion of human immunoglobulin G (IgG); soluble CTLA-4-Ig (sCTLA-4-Ig) is a soluble fusion protein between the extracellular domain of human CTLA-4 and a human Ig C gamma chain (see, e.g., Linsley et al. (1991), *J Exp Med* 174:561–569). Soluble CD28-Ig Fc (Fc portion of human IgG1) and soluble CTLA-4-Ig Fc (Fc portion of human IgG1) fusion proteins were both obtained from R&D Systems, Minneapolis, Minn. NHS-biotin was obtained from Pierce (Rockford, Ill.) and Fluorescein Isothiocyanate Isomer I (FITC) was obtained from Molecular Probes (Eugene, Oreg.).

Molar ratios of 1:38.5 for CTLA-4-Ig Fc:FITC and 1:35 for CD28-Ig Fc:Biotin were used during the conjugation. Proteins at 1–3 mg/ml were dialyzed vs 0.1 M Carbonate buffer for FITC conjugation and 0.1M Sodium Bicarbonate buffer for Biotin conjugation. Ratios of 155 ug FITC/1 mg of CTLA-4-Ig Fc and 124 ug Biotin/1 mg CD28Fc were used during the conjugation. FITC or biotin at 2 mg/ml in dimethyl sulfoxide (DMSO) was added dropwise while vortexing to dialyzed protein, incubated at 25° C. in the dark for 2 hours, and then dialyzed against PBS overnight to exchange buffers. (For additional methods, see Linsley et al., supra.)

D. Binding Activity Assays and Flow Cytometry.

Soluble CD28-Ig and soluble CTLA-4-Ig fusion proteins were conjugated with biotin and fluorescein isothiocyanate, respectively, as described above. The transfectants were treated with 0.5 mM EDTA in PBS/2% FCS for 15–30 minutes. Several representative wells were counted to determine the number of cells per well. An equal volume of conjugated sCD28-Ig (Fc) or conjugated sCTLA-4-Ig (Fc) was added to the transfected 293 or COS-7 cells at appropriate concentrations as follows. For competitive binding assays, the transfected cells were first incubated with biotin-conjugated sCD28-Ig at room temperature. FITC-conjugated CTLA-4-Ig was then added to this incubation mixture 15 minutes (min) after the addition of biotin-conjugated sCD28-Ig, and the entire mixture was incubated for an additional 1 hour and 45 minutes. (Alternatively, an individual binding assay can be performed using the same procedure, but in which the transfected cells are incubated individually with biotin-conjugated sCD28-Ig or FITC-conjugated CTLA-4-Ig.)

The labeled cells were subsequently handled at 4° C., washed twice with DMEM/10% FCS and incubated with 0.1·g/ml Streptavidin-phycoerythrin (PE) (Pharmingen, San Diego, Calif.) in 100·l for 15 min. Biotin binds the fluorescence marker Streptavidin-PE. (R-PE has an excitation maximum of 565 nanometers (nm) and an emission maximum of 578 nm. B-PE has excitation and emission maxima of 545 nm and 578 nm, respectively. FITC has excitation and emission maxima of 494 and 519, respectively.) The cells were again washed twice and resuspended in 200·l medium with 5·g/ml propidium iodide (PI). The cells were then analyzed using a FACSCalibur flow cytometer and CellQuest software (BDIS, San Jose, Calif.). Cell sorting was performed by flow-cytometry based cell sorting screening methods using FACS (Fluorescence-Activated Cell Sorting) Vantage SE cell sorter (BDIS) (Becton Dickinson; San Jose, Calif.). The staining concentration was determined for each labeled protein to provide a maximal Mean Fluorescence Intensity (MFI) and minimal background signal (e.g., optimum staining concentration was the concentration per $10^6$ cells).

Representative binding profile for the competitive binding assays are shown in FIGS. 4A–4D. For the individual binding assay, individual binding profiles would be generated for binding of the transfected cells to each of the biotin-conjugated sCD28-Ig or FITC-conjugated CTLA-4-Ig (data not shown).

For a description of flow cytometry cell sorting methods, which are known in the art, see *Current Protocols in Immunology*, John Colligan et al., eds., Vols. I–IV (John Wiley & Sons, Inc., 1991 and 2001 Supplement); Sambrook; Rapley and Walker, all supra, each of which is incorporated herein by reference in its entirety for all purposes.

E. Library Sorting/Enrichment.

Libraries were pre-enriched by FACS sorting for preferential binding to CTLA-4 over CD28 or for preferential binding to CD28 over CTLA-4. Library sorting/enrichment was performed as follows. 293 cells were transfected with a bulk population of recombinant clones from the recombinant libraries, and each transfected library was incubated with both soluble reagents sCD28-Ig and sCTLA-4-Ig (see Section D, above). Transfectants from the CTLA-4-Ig binding biased library were incubated with an optimal concentration of sCD28-Ig and a 10-fold lower concentration of sCTLA-4-Ig than optimal. Transfectants from the CD28-Ig binding biased library were labeled with optimal amounts of both soluble reagents. Cells that preferentially bound CD28 over CTLA-4 were sorted from the CD28-Ig binding biased library transfectants, and cells that preferentially bound CTLA-4 over CD28 were sorted from the CTLA-4-Ig binding biased library transfectants.

Plasmid was recovered from the sorted cells by lysis with 400µl Hirt's solution (0.6% sodium dodecyl sulfate (SDS), 10 milliMolar (mM) EDTA pH 8.0) for 0.5 hour, the addition of 100µl of 0.5 M NaCl to the lysate, and the lysate incubated over night. The lysate was spun (e.g., centrifuged at 14,000×g for 60 minutes), extracted with equal volume of Phenol/Chloroform, ethanol precipitated, and resuspended in 10µl TE buffer. The isolated plasmid was used to transform E. coli strain DH10B and the transformed cells were plated on LB agar plates. All colonies were harvested and combined and plasmid DNA was isolated using the Qiagen Maxiprep kit.

F. DNA Purification and Transfections.

E. coli strain DH10B (Life Technologies, Rockville, Md.) was transformed with Maxiprep DNA from the libraries comprising recombinant (chimeric) nucleic acid clones generated by DNA shuffling or other recursive sequence recombination procedures, as described above. The transformed cells were plated overnight. Individual colonies were picked from the plated libraries and inoculated into 96-well blocks containing 1.2 ml Terrific Broth-amp (50·g/ml). Each block was also inoculated with a pcDNA3.1-expression vector (Invitrogen, Carlsbad, Calif.) (control vector) and human CD80 each in one well. The 96-well plate cultures were grown for 20 hours at 37° C., and plasmid DNA was purified using the Biorobot (Qiagen, Valencia, Calif.). Cells of either the mammalian cell line 293 or COS-7 (or other cell line f=of interest) were plated in 96-well plates at a density of $2 \times 10^4$ cells per well the day prior to transfections. The cells were transfected with plasmids encoding a wild-type B7-1 or chimeric polypeptide using Superfect (Qiagen) or Lipofectamine (Life Technologies) according to the manufacturer's instructions.

The following procedure was used for large-scale transfections. Large-scale transfections are typically used in pre-enrichment sorts, and for the generation of therapeutic and/or prophylactic tumor vaccines, including, e.g., composition comprising NCSM polypeptide-expressing tumor cells. Human embryonic kidney 293cells (or alternatively, e.g., monkey COS-7 cells or tumor cells) were transfected with human CD80 (B7-1) plasmid DNA using Life Technologies Lipofectamine and OptiMEM medium. Per 20 cm$^2$ of plated 293 cells, 3 micrograms (·g) DNA in 200 microliters (·l) OptiMEM were combined with 181·l Lipofectamine in 200·l OptiMEM. This mixture was incubated for 15–30 minutes at 25° C., 1.6 milliliters (ml) OptiMEM were added, and 2 ml of this mixture were added per 20 cm$^2$ of plated 293 cells. Transfections were performed in T25 to T175 flasks containing 60–80% confluent 293. Cells were incubated for 5–7 hours in a 37° C. humidified incubator containing 5% CO$_2$. An equal volume of Dulbecco's modified Eagle's medium (DMEM)/20% fetal calf serum (FCS) (HyClone, Logan, Utah) was added to the flask and incubated overnight. Cells were trypsinized, replated, and incubated for 24 hours. Cells were then removed from plastic using EDTA treatment. Cells transfected with, respectively, a control vector, pcDNA3.1-expression vector (Invitrogen, Carlsbad, Calif.), or plasmid vector encoding human CD80 (B7-1) were counted and aliquoted at $2 \times 10^6$ cells/ml.

The following procedure was used for high-throughput (HTP) transfections for screening library clones in both T cell and binding assays. For Lipofectamine HTP transfections, plated 293 or COS-7 cells were washed 1× with 200·l PBS, and 50·l OptiMEM was added to each well. DNA clone concentrations were normalized to 100 ng/·l±33 ng/ul. The DNA preparation was diluted to 5 ng/·l±33% in OptiMEM, and 50·l was plated per well in empty 96-well U bottom plates. 50·l of OptiMEM with Lipofectamine at 0.03 ul/1·l OptiMEM was added to each well containing diluted DNA preparation. Each well contained 50 ng DNA±33% and 0.3·l Lipofectamine. The mix was incubated for 15 minutes at room temperature, and then 20·l per well of the mixture was added to each well containing 293 or COS-7 cells in 50·l OptiMEM. The cells were incubated at 37° C. for 5–7 hours, 70·l DMEM/20% FCS was added to each well and the plates were incubated overnight. The wells were subsequently trypsinized, washed 2× with DMEM/10% FCS, replated in sterile V-bottom plates, and incubated overnight. Alternatively, a Superfect (Qiagen) HTP protocol for transfection, and like transfection protocols, can be used by following the manufacturer's instructions.

G. T Cell Proliferation Assays

Peripheral blood was obtained from healthy blood donors as standard buffy coat preparations collected at Stanford Medical School Blood Center (Palo Alto, Calif.). Peripheral blood mononuclear cells (PBMC) were isolated from human blood by centrifugation over Histopaque-1077 (Sigma, St. Louis, Mo.) (using Ficol gradient separation).

T cells were isolated and purified either by staining the cells with anti-human CD2 monoclonal antibodies (mAbs) and sorting for CD2 positive (CD2$^+$) cells using a FACS Vantage SE or removing cells that stained with mAbs specific for CD14, CD20, CD56 and CD94 by magnetic beads (Dynabeads, Dynal, Lake Success, N.Y.); Abs were purchased from Pharmigen (San Diego, Calif.). Magnetic separation of the T cells using Dynal Dynabeads was performed by first labeling PBMCs with pure monoclonal antibodies against CD14, CD20, CD56 and CD94, then labeling the cells with Sheep anti-mouse Dynabeads. Non-T cells were removed by depleting with a magnet. The purity of the T cells was 96–99% when analyzed by staining with anti-CD3 mAbs purchased from Pharmigen (San Diego, Calif.).

T cell proliferation was measured by $^3$H-thymidine incorporation. Briefly, 293 cells (or COS-7, or other cells of interest) were transfected as described above for HTP transfections with a plasmid (expression vector) encoding a hB7-1 (or other mammalian B7-1), a chimeric CD28BP or CTLA-4BP polypeptide (i.e., a clone selected from the CD28-Ig/CTLA-4-Ig binding screen assay), or with a control vector lacking the B7-1 or NCSM nucleic acid insert. (The Effectine HTP (Qiagen, Valencia, Calif.) 96-well transfection method, which can also be used for plasmid transfections, was used to transfect cells with CTLA-4BP selected from Round 1 libraries according to the manufacturer's instructions.) Twenty-four hours after transfection, $5 \times 10^4$ purified T cells were cultured in triplicate in the presence of irradiated (5000 rads) transfectants and soluble anti-human CD3 mAbs (5·g/ml) U-bottom 96-well plates (VWR, Westchester, Pa.) at 37° C. in a humidified atmosphere containing 5% CO$_2$ in Yssel's medium supplemented with 10% FCS (200·l/well) for a total of 3 days (72 hours). 1 microCurie (·Ci)/well of $^3$H-thymidine (Amersham, Piscataway, N.J.) was added by pulsing to the cell cultures during the last 8 hours of the culture period, and the cells were harvested for counting onto filter paper by a cell harvester (Tomtec, Hamden, Conn.). $^3$H-thymidine uptake/ incorporation in the cultured cells was determined by measuring the radioactivity on the dried filters using a Micro-Beta scintillation counter (Wallac, Turku, Finland). Proliferation of T cells is expressed as the mean counts per minute (cpm) of triplicate wells. The results shown are representative of typically an average of 6 experiments. Chimeric clones that induced or inhibited T cell proliferation at a level equal to, greater than, or less than that observed with human CD80 (hB7-1) were identified and selected for further characterization.

H. Mixed Lymphocyte Culture Assay.

Proliferation of purified T cells was also measured in mixed lymphocyte cultures (MLC). Mixed lymphocyte reaction (MLR) was performed using irradiated PBMC as stimulator cells and allogeneic PBMC as responders. Stimulator cells were irradiated (2500 rads) and co-cultured with allogeneic PBMC ($1 \times 10^5$ cells/well) in 96-well flat-bottomed microtiter culture plates (VWR) at 1:1 ratio for a total of 5 days. During the last 8 hours of the culture period, the cells were pulsed with 1 uCi/well of $^3$H-thymidine, and the cells were harvested for counting onto filter paper by a cell harvester as described above. $^3$H-thymidine incorporation was measured as described above for purified T cells. Proliferation of T cells was expressed as the mean cpm of triplicate wells. The results shown representative of more than one experiment.

I. Analysis of Cytokine Levels in Culture Supernatants.

Supernatants of cell cultures from mixed lymphocyte reaction were collected after 48 hours and stored at –80° C. until they were analyzed for the presence of various cytokines. IL-10 and IFN-gamma levels were determined in duplicate using cytokine-specific ELISA kits (R&D Systems, Minneapolis, Minn.) by following the manufacturer's instructions (R&D Systems, Minneapolis, Minn.). Controls were provided in the kits.

J. Concentration-Dependent CTLA4-Ig or CD28-Ig Binding Assays.

For each particular transfectant, $2 \times 10^5$ cells were incubated with serial dilutions of CTLA-4-Ig in phosphate-buffered saline (PBS) containing 5% FCS for 30 minutes on ice. Next, the cells were washed with PBS-FCS and incubated subsequently with a saturating concentration of FITC-conjugated goat anti-human IgG mAb (Fc specific) (Caltag Laboratories, San Francisco, Calif.) for another 30 minutes on ice. The cells were analyzed using a FACSCalibur flow cytometer and CellQuest software, and cell sorting was performed using FACS Vantage SE cell sorter (BDIS) described above. Plasmids were recovered from the sorted cells by Hirt preparation as described above.

Example I

Cloning of Parent cDNA Sequences for Library Construction

The cDNAs encoding human, rhesus monkey, orangutan, baboon, bovine, rabbit, and feline B7-1 (CD80) co-stimulatory molecules were cloned by RT-PCR. These starting B7-1 genes encoded polypeptide molecules with, by comparison, amino acid sequence identities ranging from about 58–98% amino acid sequence identity using Jotun Hein method, DNASTAR (in MegaLine™ DNASTAR package, MegaLine™ Ver. 4.03), following manufacturer's instructions and using default values specified in the program. The polynucleotide sequences for baboon B7-1 (SEQ ID NO:46) and orangutan B7-1 (SEQ ID NO:47) are examples of WT NCSM polynucleotides whose sequences were previously unknown. These baboon B7-1 and orangutan B7-1 polynucleotides, as well as homologues and baboon B7-1 (SEQ ID NO:93) and orangutan B7-1 (SEQ ID NO:94) polypeptides encoded therefrom, are included as NCSM molecules of the invention.

The RAJI, PUTI, LCL8664, and 26CB-1 cell lines were used as sources of messenger or total RNA for primate B7-1 cDNA preparation as described previously. Intravenous draws of peripheral blood were used as the source of messenger or total RNA for cat, cow, and rabbit B7-1 cDNA preparation as discussed previously. Peripheral blood mononuclear cells (PBMCs) were isolated from the cat, cow, and rabbit blood draws by Ficol gradient separation.

PBMCs were activated for 2 days with medium containing lipopoly-saccharide (LPS), pokeweed mitogen (PWM) and phytohemagglutinin (PHA). Cell lines and activated PBMCs were harvested and mRNA or total RNA was isolated. cDNA was generated from messenger or total RNA by using the Invitrogen cDNA Cycle kit. By using primers specific for each species, double-stranded cDNA was generated via PCR.

Example II

Preparation and Screening of Round I NCSM Libraries

Nucleic acid libraries comprising recombinant nucleic acid sequences were generated by using the seven cloned cDNA wild-type CD80 nucleic acid sequences as parental sequences and applying recursive sequence recombination methods as described above to such sequences. In one aspect, libraries comprising chimeric nucleic acid sequences were generated by applying DNA shuffling procedures to the seven mammalian cDNA sequences as described previously in, e.g., Stemmer, W. (1994) *Nature* 370:389–391 (1994) and Crameri, A. et al. (1998) *Nature* 391:288–91, each of which is incorporated herein by reference in its entirety for all purposes. Sequencing of randomly selected chimeric clones a recombinant library indicated that 12 out of 12 clones comprised nucleotide fragments from at least two of the starting genes, illustrating efficient chimerism.

Initial screening of the resulting chimeric NCSM clones was based on binding assays in which binding of a polypeptide encoded by a clone nucleic acid and expressed on the surface of a cell transfected for one of the two B7-1 ligands, CD28 or CTLA-4, was evaluated. For a detailed review of the binding assays, see the "Materials and Methods" section above. In brief, cells from a human HEK 293 cell line were transfected with plasmid DNA of the resulting recombinant libraries of recursively recombined NCSM polynucleotides. Library transfectants were incubated with soluble CD28-Ig and CTLA-4-Ig conjugated with fluorescence-indicators, and sorted according to their fluorescence via FACS-sorting and 96-well format HTP transfections. The invention is not limited by the choice of fluorescence indicator molecules used (i.e., numerous indicator molecules may be used).

Flow cytometry-based cell sorting was used to screen the libraries for clones with increased or decreased relative binding to CD28 and CTLA-4. (Fluorescently-labeled soluble CD28-Ig and CTLA-4-Ig molecules were used as soluble CD28 and CTLA-4 receptors, respectively, in the competitive or individual binding assays.) Transfected cells that preferentially bound CD28 over CTLA-4 (as compared to CD28 and CTLA-4 binding of wild-type co-stimulatory B7-1 molecules, such as, e.g., hB7-1) in an individual or competitive binding assay were sorted out from the library transfectants as were cells that preferentially bound CTLA-4 over CD28 (again, as compared to CD28 and CTLA-4 binding of wild-type B7-1 molecules, such as, e.g., hB7-1) in an individual or competitive binding assay. A large fraction of the cell-surface displayed shuffled chimeric molecules displayed exhibited binding to either sCD28-Ig or sCTLA-4-Ig. Less than 10% of the randomly selected chimeras demonstrated no binding to either sCD28-Ig or sCTLA-4-Ig (data not shown), indicating high functional fitness of polypeptides and proteins generated by DNA shuffling of natural wild-type mammalian B7-1 genes.

Plasmid DNA encoding the recursively recombined NCSM molecules was recovered from both categories of sorted cells and DNA was prepared for binding assays. In the binding assays, DNA from individual clones was transfected into human HEK 293 cells (or COS or other cells of interest), and the cells were analyzed for the ability to preferentially bind either fluorescent-labeled sCD28-Ig or fluorescent-labeled sCTLA-4-Ig (either separately or competitively), as compared to the binding of cells expressing wild-type B7-1 to the labeled sCD28-Ig or sCTLA-4-Ig. Clones exhibiting preferential binding for either CD28 or CTLA, as compared to the binding of wild-type (WT) B7-1 to CD28 or CTLA-4, were then analyzed by DNA sequencing, amino acid sequencing, and functional assays as described below.

Subsequent analysis of 1000 individual clones recovered from the sorted cells identified a number of clones with altered ligand binding profiles for CD28 and CTLA-4 relative to the binding of wild-type B7-1 to CD28 and CTLA-4. Four clones with preferential binding to sCD28-Ig over sCTLA-4-Ig (compared to the relative binding of WT hB7-1 to sCD28-Ig and sCTLA-4-Ig) were subjected to more detailed analysis; reduced binding of these clones to sCTLA-4-Ig was observed in at least two separate experiments, while their binding to sCD28-Ig remained intact (data not shown). Although the level of binding of these clones to sCTLA-4-Ig was reduced, however, it was still detectable (data not shown). Preferential binding to sCTLA-4-Ig over sCD28-Ig (compared to the relative binding of WT hB7-1 to sCD28-Ig and sCTLA-4-Ig) was observed in at least 15 clones of the 1000 individual Round 1 clones analyzed by flow cytometry (data not shown). Again, the loss of binding to sCD28-Ig was only partial.

Based on the results of this screening assay, exemplary NCSM molecules having a desired phenotype comprising an altered CD28/CTLA-4 binding affinity ratio or CTLA-4/CD28 binding affinity ratio (relative to that of WT hB7-1) were identified. Plasmid DNA encoding NCSM molecules of these selected clones was recovered and DNA was prepared for subsequent binding and T cell proliferation functional assays.

In T cell proliferation assays, DNA from each of the selected exemplary CD28BP or CTLA44BP clones identified in the binding assays was transfected into either monkey (COS-7) or human embryonic kidney (human 293 cell line) cells in vitro, using procedures described above, and tested for an ability to induce or inhibit T cell proliferation as compared to human wild-type B7-1. Anti-CD28 mAbs can be used as a positive control. (An alternative functional test is to transfect or vaccinate human or animal cells in vivo with the nucleic acid from a selected clone, as described below.) To stimulate T cell activation via two-signaling pathway, human T cells were incubated with the cells expressing a selected NCSM molecule and anti-CD3 antibody. See "T Cell Proliferation Assays" in "Materials and Methods." For example, by incubating T cells with anti-CD3 antibody and cells expressing a CD28BP of the invention, the cell surface-expressed CD28BP bound CD28 receptor on the T cells and the anti-CD3 bound the CD3 T cell receptor. This was followed by addition of $H^3$-thymidine to measure the increase in DNA synthesis (a commonly used indication of cell proliferation), as described previously. FIGS. 10 and 12 illustrate results of T cell proliferation assays.

Clones that induced T cell proliferation that was equal to or higher than that induced by WT hB7-1 were identified and selected for further characterization from the recombinant nucleic acid library pre-enriched by FACS sorting for clones having preferential binding to CD28 over CTLA-4. Four exemplary clones having the most biased binding to CD28 and an ability to induce a cell proliferation response equal to or higher than that induced by WT hB7-1 were identified and designated Round 1 (R1) CD28BP-71, -84, -118, and -126 clones. Amino acid and nucleic acid sequences of these NCSM clones were determined using standard sequencing techniques described above.

Clones that reduced or suppressed T cell proliferation relative to the that generated by WT human B7-1 were identified and selected for further characterization from the recombinant nucleic acid library pre-enriched by FACS sorting for clones having preferential binding to CTLA-4 over CD28. Five exemplary clones exhibiting the most biased binding to CTLA-4 and the ability to reduce or suppress a T cell proliferation relative to that generated by WT human B7-1 were identified and designated R1 CTLA-4BP-5, -7, -11, -13, and -27 clones. The amino acid and nucleic acid sequences of these NCSM clones were determined using standard sequence techniques as described above.

Round 1 clones showed diverse amino acid and nucleotide differences from wild-type B7-1 sequences. For example, R1 CTLA4BP clones demonstrated a 93.4–97.6% amino acid identity with a wild-type B7-1 molecule and a 97–98.5% identity at the nucleotide level. In competitive binding assays using CD28-Ig and CTLA-4-Ig, the R1 CTLA-4BPs displayed preferential binding to CTLA-4-Ig as compared to the wild-type B7-1 binding preference to CD28-Ig and CTLA-4-Ig.

Example III

Preparation and Screening of Round 2 NCSM Libraries

The nucleotide sequences (or nucleotide segments or fragments thereof) corresponding to R1 CD28BP-71, -84, -118, and -126 clones were used as parental sequences for recursive sequence recombination in the generation of a second round CD28BP NCSM recombinant nucleic acid library. The nucleotide sequences (or nucleotide segments or fragments thereof) corresponding to R1 CTLA-4BP-5, -7, -11, -13, and -27 clones were used as parental sequences for DNA shuffling in the generation of a second round CTLA-4BP NCSM recombinant nucleic acid library. As in Round 1, the nucleotide sequences corresponding to the selected CD28BP clones were recursively recombined with one another and the selected CTLA-4BPs were recursively recombined with one another by DNA shuffling in parallel experiments. Two separate sets of libraries were generated (one derived from the selected CD28BP parental clones and one derived from the selected CTLA-4BP clones). Binding assays were performed as previously described on the recombinant libraries generated in Round 2 (e.g., libraries containing recursive sequence recombinants were incubated with soluble CD28-Ig and CTLA-4-Ig conjugated with fluorescence indicators, and sorted according to their fluorescence binding profiles).

Screening of 1000 individual clones from both libraries identified a number of clones that exhibited strongly biased binding to either sCD28-Ig or sCTLA-4-Ig. The second round of breeding resulted in a number of different clones exhibiting biased (altered) binding to sCD28-Ig or sCTLA-4-Ig, respectively. For example, a number of Round 2 (R2) CD28BP clones showed even greater preferential binding to CD28 than did the R1 CD28BP clones. Similarly, a number of R2 CTLA-4BP clones showed even greater preferential binding to CTLA-4 than did the R1 CTLA-4BP clones. From the shuffled recombinant libraries of the second round of breeding, a number of clones with further biased binding to sCD28-Ig or sCTLA-4-Ig, respectively, as compared to the clones selected from the first round of breeding (data not shown), were selected from the Round 2 libraries using the same criteria as in Round 1. The clones displayed a range of expression on the stable transfectants as compared to WT hB7-1 transfectants. The plasmid DNA for selected clones was recovered and DNA prepared for further binding and functional assays. In addition, the amino acid and nucleic acid sequences of these clones were determined using standard procedures known in the art.

A. Round 2 Clones With Preferential Binding Properties.

Seventeen R2 CD28BP clones were found to have preferential binding to CD28 over CTLA-4 as shown in both individual and competitive binding assays between these cells transfected with these clones and soluble CD28-Ig fusions and/or CTLA4-Ig fusions. Binding profiles for the 17 clones are shown in FIG. 5. These clones were designated clones Round 2 (R2) CD28BP-1 through CD28BP-17 and their respective amino acid and nucleic acid sequences were determined (see Table 3). Thirty-six R2 CD28BP clones were also found to have preferential binding to CD28 over CTLA-4 relative to WT hB7-1 as demonstrated in both individual and competitive binding assays between these cells transfected with these clones and soluble CD28-Ig fusions and/or CTLA4-Ig fusions. These clones were designated clones R2 CD28A12–5 through CD28E2–4 and their respective amino acid and nucleic acid sequences were determined (see Table 3). Twelve R2 CD28BP clones binding profiles similar to that of WT hB7-1 were also selected from both R2 libraries and their respective amino acid and nucleic acid sequences were determined. Binding profiles for other recombinant CD28BP clones described herein were also generated (data not shown).

TABLE 3

| Nucleic acid SEQ ID NO: | Protein SEQ ID NO: | Clone ID | Binding Score |
|---|---|---|---|
| SEQ ID NO:1 | SEQ ID NO:48 | R1clone71 | 1 |
| SEQ ID NO:2 | SEQ ID NO:49 | R1clone 84 | 1 |
| SEQ ID NO:3 | SEQ ID NO:50 | R1clone 118 | 1 |
| SEQ ID NO:4 | SEQ ID NO:51 | R1clone 126 | 1 |
| SEQ ID NO:5 | SEQ ID NO:52 | CD28BP1 | 2 |
| SEQ ID NO:6 | SEQ ID NO:53 | CD28BP2 | 2 |

TABLE 3-continued

| Nucleic acid SEQ ID NO: | Protein SEQ ID NO: | Clone ID | Binding Score |
|---|---|---|---|
| SEQ ID NO:7 | SEQ ID NO:54 | CD28BP3 | 2 |
| SEQ ID NO:8 | SEQ ID NO:55 | CD28BP4 | 2 |
| SEQ ID NO:9 | SEQ ID NO:56 | CD28BP5 | 2 |
| SEQ ID NO:10 | SEQ ID NO:57 | CD28BP6 | 2 |
| SEQ ID NO:11 | SEQ ID NO:58 | CD28BP7 | 2 |
| SEQ ID NO:12 | SEQ ID NO:59 | CD28BP8 | 2 |
| SEQ ID NO:13 | SEQ ID NO:60 | CD28BP9 | 2 |
| SEQ ID NO:14 | SEQ ID NO:61 | CD28BP10 | 2 |
| SEQ ID NO:15 | SEQ ID NO:62 | CD28BP11 | 2 |
| SEQ ID NO:16 | SEQ ID NO:63 | CD28BP12 | 2 |
| SEQ ID NO:17 | SEQ ID NO:64 | CD28BP13 | 2 |
| SEQ ID NO:18 | SEQ ID NO:65 | CD28BP14 | 2 |
| SEQ ID NO:19 | SEQ ID NO:66 | CD28BP15 | 2 |
| SEQ ID NO:20 | SEQ ID NO:67 | CD28BP16 | 2 |
| SEQ ID NO:21 | SEQ ID NO:68 | CD28BP17 | 2 |
| SEQ ID NO:95 | SEQ ID NO:174 | CD28A12-5 | 1 |
| SEQ ID NO:96 | SEQ ID NO:175 | CD28A4-5* | 1 |
| SEQ ID NO:97 | SEQ ID NO:176 | CD28A4-9 | 1 |
| SEQ ID NO:98 | SEQ ID NO:177 | CD28A6-9 | 1 |
| SEQ ID NO:99 | SEQ ID NO:178 | CD28A6-1 | 1 |
| SEQ ID NO:100 | SEQ ID NO:179 | CD28A8-4 | 1 |
| SEQ ID NO:101 | SEQ ID NO:180 | CD28A8-6 | 1 |
| SEQ ID NO:102 | SEQ ID NO:181 | CD28B2-8 | 1 |
| SEQ ID NO:103 | SEQ ID NO:182 | CD28B4-3 | 1 |
| SEQ ID NO:104 | SEQ ID NO:183 | CD28B6-3 | 1 |
| SEQ ID NO:105 | SEQ ID NO:184 | CD28B6-6 | 1 |
| SEQ ID NO:106 | SEQ ID NO:185 | CD28B8-5* | 1 |
| SEQ ID NO:107 | SEQ ID NO:186 | CD28C11-5 | 2 |
| SEQ ID NO:108 | SEQ ID NO:187 | CD28C6-1 | 1 |
| SEQ ID NO:109 | SEQ ID NO:188 | CD28C7-3 | 1 |
| SEQ ID NO:110 | SEQ ID NO:189 | CD28C8-6 | 2 |
| SEQ ID NO:111 | SEQ ID NO:190 | CD28C9-5* | 1 |
| SEQ ID NO:112 | SEQ ID NO:191 | CD28C2-4 | 1 |
| SEQ ID NO:113 | SEQ ID NO:192 | CD28D2-3 | 1 |
| SEQ ID NO:114 | SEQ ID NO:193 | CD28D2-9 | 1 |
| SEQ ID NO:115 | SEQ ID NO:194 | CD28D8-9 | 1 |
| SEQ ID NO:116 | SEQ ID NO:195 | CD28D11-1 | 2 |
| SEQ ID NO:117 | SEQ ID NO:196 | CD28D12-5 | 2 |

TABLE 3-continued

| Nucleic acid SEQ ID NO: | Protein SEQ ID NO: | Clone ID | Binding Score |
|---|---|---|---|
| SEQ ID NO:118 | SEQ ID NO:197 | CD28E10-6 | 1 |
| SEQ ID NO:119 | SEQ ID NO:198 | CD28F7-2 | 2 |
| SEQ ID NO:120 | SEQ ID NO:199 | CD28F8-4 | 1 |
| SEQ ID NO:121 | SEQ ID NO:200 | CD28F10-2 | 1 |
| SEQ ID NO:122 | SEQ ID NO:201 | CD28F12-5* | 1 |
| SEQ ID NO:123 | SEQ ID NO:202 | CD28G2-8 | 1 |
| SEQ ID NO:124 | SEQ ID NO:203 | CD28G1-5 | 1 |
| SEQ ID NO:125 | SEQ ID NO:204 | CD28G1-9 | 1 |
| SEQ ID NO:126 | SEQ ID NO:205 | CD28H4-3 | 1 |
| SEQ ID NO:127 | SEQ ID NO:206 | CD28H11-3 | 1 |
| SEQ ID NO:128 | SEQ ID NO:207 | CD28H6-6 | 1 |
| SEQ ID NO:129 | SEQ ID NO:208 | CD28E2-4 | 1 |
| SEQ ID NO:130 | SEQ ID NO:209 | CD28B4-5a | 1 |
| SEQ ID NO:131 | SEQ ID NO:210 | CD28A2-5 | 0 |
| SEQ ID NO:132 | SEQ ID NO:211 | CD28B4-5* | 0 |
| SEQ ID NO:133 | SEQ ID NO:212 | CD28D5-6 | 0 |
| SEQ ID NO:134 | SEQ ID NO:213 | CD28D10-4 | 0 |
| SEQ ID NO:135 | SEQ ID NO:214 | CD28E2-5* | 0 |
| SEQ ID NO:136 | SEQ ID NO:215 | CD28E5-2 | 0 |
| SEQ ID NO:137 | SEQ ID NO:216 | CD28E8-6 | 0 |
| SEQ ID NO:138 | SEQ ID NO:217 | CD28E9-6 | 0 |
| SEQ ID NO:139 | SEQ ID NO:218 | CD28F3-1 | 0 |
| SEQ ID NO:140 | SEQ ID NO:219 | CD28F3-5 | 0 |
| SEQ ID NO:141 | SEQ ID NO:220 | CD28F3-6 | 0 |
| SEQ ID NO:142 | SEQ ID NO:221 | CD28F11-8 | 0 |

Table 3 above presents a summary of the relative binding activities of these selected R2 CD28BP NCSM clones based on three exemplary binding profiles shown in FIGS. 6B(1)–6B(3). In the three exemplary binding profiles, the Y-axis represents binding to CD28, and the X-axis represents binding to CTLA-4. An exemplary binding profile for the binding of WT B7-1 to CD28 and CTLA-4 is shown in FIG. 6B(1), indicating approximately equal binding affinity of WT B7-1 to CD28 and CTLA-4. An example of a binding profile indicating high preferential binding to CD28 over CTLA-4 relative to that of WT B7-1 is shown in FIG. 6B(3); that is, the clone has a CD28/CTLA-4 binding affinity ratio significantly greater than the CD28/CTLA-4 binding affinity ratio of WT hB7-1. An example of a binding profile indicating intermediate preferential binding to CD28 over CTLA-4 relative to that of WT B7-1 is shown in FIG. 6B(2) (i.e., a CD28/CTLA-4 binding affinity ratio greater than the CD28/CTLA-4 binding affinity ratio of WT hB7-1).

A score is assigned to each clone based upon comparison to the three exemplary binding profiles. A score of zero (0) indicates the CD28BP clone has a binding profile equivalent or substantially equivalent to that of WT B7-1. A score of 1 indicates the CD28BP clone has a binding profile similar to that shown in FIG. 6B(2) (i.e., CD28/CTLA-4 binding affinity ratio greater than the CD28/CTLA-4 binding affinity ratio of WT hB7-1). A score of 2 indicates the clone has a binding profile similar to that shown in FIG. 6B(3) (i.e., a CD28/CTLA-4 binding affinity ratio significantly greater than the CD28/CTLA-4 binding affinity ratio of WT hB7-1). Table 3 shows the clone identification (ID) name for each selected R2 CD28BP clone and its score.

R2 CD28BP clones 3, 6, and 9 (corresponding to nucleic acid sequences SEQ ID NOS:7, 10, and 13, and amino acid sequences 54, 57, and 60, respectively) comprise identical amino acid and nucleic acid sequences; the competitive binding assays and T cell proliferation assays for these clones were conducted in a repeated manner to verify functional activity. Clones Round 2 CD28BP-1 and -12 comprise identical amino acid sequences (amino acid sequences SEQ ID NOS:52 and 63, respectively); however, the nucleic acid sequences of clones R2 CD28BP-1 and -12 (nucleic acid sequences SEQ ID NOS:5 and 16, respectively) differ from one another by one nucleic acid residue at position 894 in both sequences. Clone 1 has nucleic acid residue C at position 894 (with the resulting codon TCC encoding Ser); clone 12 has nucleic acid residue T at position 894 (with the resulting codon TCT also encoding Ser).

Fifty R2 CTLA-4BP clones were found to have preferential binding to CD28 over CTLA-4 as shown in both individual and competitive binding assays between cells transfected with these clones and fluorescently labeled soluble CD28-Ig fusions and/or CTLA4-Ig fusions. Exemplary binding profiles for selected clones are shown in FIGS. 7A–7H. The respective amino acid and nucleic acid sequences of the clones were determined (Table 4). Table 4 presents a summary of the relative binding activities of these selected 50 R2 CTLA-4BP clones based on the three exemplary binding profiles shown in FIGS. 6A(1)–6A(3). In the three exemplary competitive binding profiles, the Y-axis represents binding to CD28, and the X axis represents binding to CTLA-4 (see binding assays described in "Materials and Methods"). An exemplary binding profile for the binding of WT B7-1 to CD28 and CTLA-4 is shown in FIG. 6A(1), indicating approximately equal binding affinity of WT B7-1 to CD28 and CTLA-4. An exemplary binding profile indicating for a particular clone a preferential binding to CTLA-4 over CD28 relative to that of WT B7-1 is shown in FIG. 6A(3); the clone has a CTLA4/CD28 binding affinity ratio significantly greater than the CTLA-4/CD28 binding affinity ratio of WT hB7-1. An exemplary binding profile indicating intermediate preferential binding to CD28 over CTLA-4 relative to that of WT B7-1 is shown in FIG. 6A(2); the clone has a CTLA4/CD28 binding affinity ratio greater than that of WT hB7-1.

A score is assigned to each NCSM clone based upon comparison to the three exemplary binding profiles. A score of zero (0) indicates the CTLA-4BP clone has a binding profile similar or equivalent to that of WT B7-1. A score of 1 indicates the CTLA-4BP clone has a binding profile similar or equivalent to that shown in FIG. 6A(2) (i.e., with a CTLA-4/CD28 binding affinity ratio greater than the CTLA-4/CCD28 binding affinity ratio of WT hB7-1). A score of 2 indicates the CTLA-4BP clone has a binding profile similar or equivalent to that shown in FIG. 6A(3) (i.e., with a CTLA-4/CD28 binding affinity ratio significantly greater than that of WT hB7-1). The clone identification (ID) name and score assigned to each selected CTLA- 4BP clone are shown in Table 4. Binding profiles for other CTLA-4BP clones described herein were also generated (data not shown).

TABLE 4

| Nucleic acid SEQ ID NO: | Protein SEQ ID NO: | Clone ID | Binding Score |
|---|---|---|---|
| SEQ ID NO:22 | SEQ ID NO:69 | R1-5 | 2 |
| SEQ ID NO:23 | SEQ ID NO:70 | R1-7 | 1 |
| SEQ ID NO:24 | SEQ ID NO:71 | R1-11 | 1 |
| SEQ ID NO:25 | SEQ ID NO:72 | R1-13 | 1 |
| SEQ ID NO:26 | SEQ ID NO:73 | R1-27 | 1 |
| SEQ ID NO:27 | SEQ ID NO:74 | 5×2-10c | 2 |
| SEQ ID NO:28 | SEQ ID NO:75 | 5×2-11d | 2 |
| SEQ ID NO:29 | SEQ ID NO:76 | 5×2-12F | 1 |
| SEQ ID NO:30 | SEQ ID NO:77 | 5×2-2g | 2 |
| SEQ ID NO:31 | SEQ ID NO:78 | 5×2-3c | 2 |
| SEQ ID NO:32 | SEQ ID NO:79 | 5×2-4c | 1 |
| SEQ ID NO:33 | SEQ ID NO:80 | 5×2-7b | 1 |
| SEQ ID NO:34 | SEQ ID NO:81 | 5×2-8c | 2 |
| SEQ ID NO:35 | SEQ ID NO:82 | 5×3-10e | 2 |
| SEQ ID NO:36 | SEQ ID NO:83 | 5×3-11B | 1 |
| SEQ ID NO:37 | SEQ ID NO:84 | 5×3-6f | 2 |
| SEQ ID NO:38 | SEQ ID NO:85 | 5×4-11D | 2 |
| SEQ ID NO:39 | SEQ ID NO:86 | 5×4-12C | 2 |
| SEQ ID NO:40 | SEQ ID NO:87 | 5×4-1F | 2 |
| SEQ ID NO:41 | SEQ ID NO:88 | 5×5-2E | 2 |
| SEQ ID NO:42 | SEQ ID NO:89 | 5×5-6E | 2 |
| SEQ ID NO:43 | SEQ ID NO:90 | 5×6-9D | 2 |
| SEQ ID NO:44 | SEQ ID NO:91 | 5×8-1F | 2 |
| SEQ ID NO:45 | SEQ ID NO:92 | 5×9-12C | 2 |
| SEQ ID NO:143 | SEQ ID NO:222 | 5×9-d10 | 1 |
| SEQ ID NO:144 | SEQ ID NO:223 | 5×6-f6 | 1 |
| SEQ ID NO:145 | SEQ ID NO:224 | 5×5-h12 | 1 |
| SEQ ID NO:146 | SEQ ID NO:225 | 5×5-c10 | 1 |
| SEQ ID NO:147 | SEQ ID NO:226 | 5×3-e8 | 1 |
| SEQ ID NO:148 | SEQ ID NO:227 | 5×3-c4 | 1 |
| SEQ ID NO:149 | SEQ ID NO:228 | 5×3-c3 | 1 |
| SEQ ID NO:150 | SEQ ID NO:229 | 5×2-h11 | 1 |
| SEQ ID NO:151 | SEQ ID NO:230 | 5×2-d7 | 1 |
| SEQ ID NO:152 | SEQ ID NO:231 | 5×2-b7 | 1 |
| SEQ ID NO:153 | SEQ ID NO:232 | 5×2-b1 | 1 |
| SEQ ID NO:154 | SEQ ID NO:233 | 5×1-f1 | 1 |

TABLE 4-continued

| Nucleic acid SEQ ID NO: | Protein SEQ ID NO: | Clone ID | Binding Score |
|---|---|---|---|
| SEQ ID NO:155 | SEQ ID NO:234 | 5×1-d7 | 1 |
| SEQ ID NO:156 | SEQ ID NO:235 | 2×4-g9 | 1 |
| SEQ ID NO:157 | SEQ ID NO:236 | 2×4-a6 | 1 |
| SEQ ID NO:158 | SEQ ID NO:237 | 2×2-f3 | 1 |
| SEQ ID NO:159 | SEQ ID NO:238 | 2×2-f12 | 1 |
| SEQ ID NO:160 | SEQ ID NO:239 | 2×1-g8 | 1 |
| SEQ ID NO:161 | SEQ ID NO:240 | 2×1-f10 | 1 |
| SEQ ID NO:162 | SEQ ID NO:241 | 2×1-c9 | 1 |
| SEQ ID NO:163 | SEQ ID NO:242 | 2×1-h12 | 1 |
| SEQ ID NO:164 | SEQ ID NO:243 | 2×1-e2 | 1 |
| SEQ ID NO:165 | SEQ ID NO:244 | 2×1-c4 | 1 |
| SEQ ID NO:166 | SEQ ID NO:245 | 2×1-b12 | 1 |
| SEQ ID NO:167 | SEQ ID NO:246 | 2×2-f1 | 1 |
| SEQ ID NO:168 | SEQ ID NO:247 | 5×4-h1 | 2 |
| SEQ ID NO:169 | SEQ ID NO:248 | 5×4-a1 | 0 |
| SEQ ID NO:170 | SEQ ID NO:249 | 5×2-f3 | 0 |
| SEQ ID NO:171 | SEQ ID NO:250 | 5×2-e12 | 0 |
| SEQ ID NO:172 | SEQ ID NO:251 | 2×4-h11 | 0 |
| SEQ ID NO:173 | SEQ ID NO:252 | 2×3-h2 | 0 |
| SEQ ID NO:253 | SEQ ID NO:263 | A-H3-6 | 1 |
| SEQ ID NO:254 | SEQ ID NO:264 | A-B11-5 | 1 |
| SEQ ID NO:255 | SEQ ID NO:265 | A-E2-6 | 1 |
| SEQ ID NO:256 | SEQ ID NO:266 | A-F1-6 | 1 |
| SEQ ID NO:257 | SEQ ID NO:267 | A-F6-9 | 1 |
| SEQ ID NO:258 | SEQ ID NO:268 | A-H4-5* | 1 |
| SEQ ID NO:259 | SEQ ID NO:269 | A-B4-6 | 1 |
| SEQ ID NO:260 | SEQ ID NO:270 | A-F10-1 | 1 |
| SEQ ID NO:261 | SEQ ID NO:271 | A-G8-1 | 1 |
| SEQ ID NO:262 | SEQ ID NO:272 | A-C9-9 | 0 |

The plasmids corresponding to the 36 clones displaying preferential binding to CD28 over CTLA-4 relative to that of WT hB7-1 were recovered; each corresponding CD28BP molecule was recovered, and nucleic acid and amino acid sequences were determined. The clones were assigned scores of 2 and 1, as shown in Table 3, depending upon the magnitude of the observed preferential binding.

Figure 10:
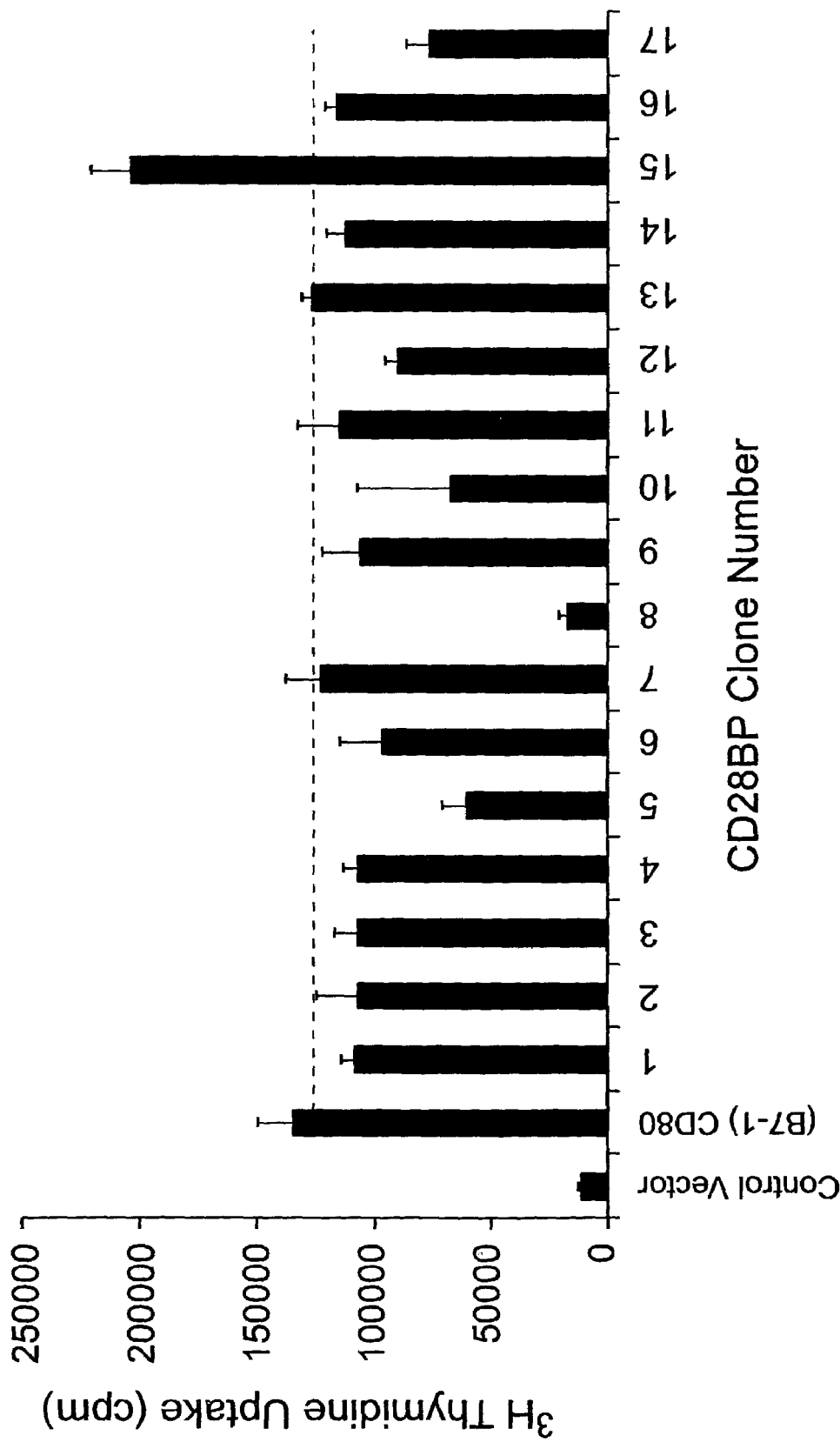
FIG. 10 shows a graph depicting T cell proliferation response, as measured by $^3$H thymidine incorporation, resulting from the co-culturing of cells transfected with one of seventeen CD28BP clones, human B7-1 (CD80), or an empty control vector cultured with anti-CD3 mAbs.

The plasmids for the 12 R2 clones from the CD28BP R2 library that displayed CD28 and CTLA-4 binding profiles equal or approximately equivalent to that of WT B7-1 were recovered; each corresponding clone molecule was recovered and its nucleic acid and amino acid sequences were determined. These clones were assigned a score of zero, as shown in Table 3.

Two groups of R2 CTLA-4BP clones (19 in the first group, Group I, and 26 in the second group, Group II) were identified as having preferential binding to CTLA-4 over CD28 relative to that of hB7-1 as demonstrated in competitive binding assays between cells transfected with these clones and fluorescently labeled soluble CD28-Ig fusions and/or CTLA4-Ig fusions. These clones are identified in Table 4, which indicates the clone ID name and binding score (as explained with regard to Table 3); the amino acid and nucleic acid sequences for each CTLA-4BP clone were determined. In general, the R2 clones displayed a greater degree of CTLA-4 binding preference than the R1 clones. In addition, five R2 clones from the CTLA-4 R2 library with binding profiles equal or approximately equivalent to that of WT human B7-1 were identified. Plasmids for all such clones were recovered; the nucleic acid and amino acid sequences were determined for each clone, and each clone was assigned a binding score (see Table 4).

Preferred or enhanced binding of a selected clone to CD28 over CTLA-4 relative to hB7-1 was observed by an increase in the observed CD28/CTLA-4 binding affinity ratio for the clone compared to the CD28/CTLA-4 binding affinity ratio of hB7-1. Preferred or enhanced binding of a selected clone to CTLA-4 over CD28 relative to hB7-1 is observed by an increase in the observed CTLA-4/CD28 binding affinity ratio for the clone compared to the CTLA-4/CD28 binding affinity ratio of hB7-1.

The R2 selected clone that exhibited the greatest increase in CD28/CTLA-4 binding affinity ratio compared to the CD28/CTLA-4 binding affinity ratio of hB7-1 was clone R2 CD28BP-15. The identified clone that exhibited the greatest increase in CTLA-4/CD28 binding affinity ratio compared to the CTLA-4/CD28 binding affinity ratio of hB7-1 was clone R2 CTLA-4BP 5x4-12c. FIGS. 4A–4D show a characterization of competitive ligand binding properties of CD28BP-15 and CTLA-4BP 5x4-12c compared to human B7-1. 293 cells transfected with CD28BP-15, CTLA-4BP 5x4-12c, hB7-1, or a negative control vector (which did not contain the B7-1, CTLA4-BP, or CD28BP nucleotide sequence insert) were stained with fluorescently labeled biotin-conjugated sCD28-Ig or FITC-conjugated CTLA-4-Ig fusion proteins. The results of a representative flow cytometry analysis are shown in FIGS. 4A–4D; similar results were obtained in five other experiments. Transfectants expressing CD28BP-15 or CTLA-4BP 5x4-12c, and stained under identical conditions, demonstrated dramatically altered ligand binding profiles, as compared to transfectants expressing hB7-1 stained in an identical manner. In particular, CD28BP-15 showed a significantly changed binding profile to CD28 as compared to the binding of hB7-1 to CD28. CD28BP-15 also showed a significant loss of CTLA-4 binding as compared to the binding of human B7-1 to CTLA-4.

FIGS. 8A–8B show the respective amino acid sequences for CD28BP-12 and CTLA-4BP 5x4-12c and the genealogy of these sequences. The nucleotide and amino acid sequences for each of CD28BP-12 and CTLA-4BP 5x4-12c were aligned with the starting genes to identify the parental origins of the recombinant sequences. The chimeric nature of each recombinant amino acid sequence is indicated by a solid labeled line designating each amino acid subsequence derived from a particular parental species sequence. Any amino acid residue that differs from a residue in the WT human B7-1 sequence in the corresponding (equivalent) amino acid residue position is indicated with a star (*). Three point mutations in CTLA-4BP 5x4-12c that were not derived from any of the starting parental genes are indicated with a solid triangle. The predicted transmembrane domain is illustrated with a dashed line (prediction based on equivalent analysis for mammalian B7-1 molecules in Parsons, K. R. & Howard, C. J. (1999) *Immunogenetics* 49:231–4).

Sequence analysis of CD28BP-15 indicated the amino acid sequence comprised a chimera derived principally from human, bovine, and rabbit sequences (FIG. 8B). The remaining clones selected from the libraries resulting from second round of recombination that displayed preferential binding to CD28 over CTLA-4 shared about 74 to about 99% sequence identity with CD28BP-15 based on sequence alignment comparisons (using DNASTAR or Vector NTI algorithm with default parameters as described above), illustrating the diversity of clones having the preferential binding properties. The nucleotide and amino acid sequence identities of CD28BP-15 with human B7-1 were 73% and 61%, respectively (using DNASTAR or Vector NTI algorithm with default parameters). Based on amino acid sequence alignments, all of the selected CD28BP clones exhibiting preferential binding to CD28 over CTLA-4 relative to hB7-1 contained a substitution of valine for isoleucine at amino acid position 49 (Ile49Val) of the mature CD28BP-15 amino acid sequence (corresponding to alignment with the mature hB7-1 sequence). This substitution corresponds to a substitution at amino acid position 85 in the full-length CD28BP-15 and amino acid position 83 in full-length human B7-1, since CD28BP-15 includes two additional amino acid residues in the putative sequence. Although Ile49 does not appear to be directly involved in the interaction of B7-1 with CTLA-4 (see, e.g., Stamper, C. et al. (2001) *Nature* 410:608–611), substitution Ile49Ala was previously shown to completely abolish binding of B7-1 to both CD28 and CTLA-4, suggesting the importance of this residue in the ligand binding (Peach, R. J. et al. (1995) *J Biol Chem* 270:21181–7). Although the Ile49Val substitution is also considered a conservative replacement, our data suggest that mutations derived from naturally existing genes, in this case from the bovine B7-1 gene sequence, provide improved means to search for altered functional properties in proteins. Notably, bovine CD28 receptor is the only exception among CD28 and CTLA-4 receptor amino acid sequences analyzed from 12 different species in which the hexapeptide MYPPPY and Gly-66 are not fully conserved in the receptor sequence (i.e., MYPPPY is replaced by LYPPPY, and Gly-66 is replaced by valine (see Metzler, W. J. et al. (1997) *Nat Struct Biol* 4:527–31). The hexapeptide MYPPPY is conserved in the F-G loop of both CD28 and CTLA-4 in a variety of mammalian species. Mutation of any residue in the MYPPPY sequence leads to reduced binding to B7-1 and B7-2 (see id.), and all these residues, with the exception of Pro101, are in direct contact with B7-1 (Stamper, C. et al. (2001) *Nature* 410:608–611), suggesting that changes in this region of bovine CD28 receptor have driven the natural evolution of bovine B7-1 to acquire properties that also benefited the in vitro evolution of CD28BP described herein.

CTLA-4BP 5x4-12c contained amino acid sequences corresponding principally to the human, baboon, rhesus monkey and bovine B7-1 genes (FIG. 8A), and the nucleotide and amino acid sequences of CTLA-4BP were 97% and 96% identical with those of hB7-1, respectively. In addition, CTLA-4BP 5x4-12c contained three amino acid mutations that were not derived from any of the starting genes (FIG. 8A). The remaining clones with preferential binding to sCTLA-4-Ig over sCD28-Ig in the binding assays exhibited 95–99% identity with CTLA-4BP 5x4-12c (e.g., using DNASTAR or Vector NTI algorithm with default parameters).

Tyr-31 in the mature sequence of CTLA-4 5x4-12c was replaced by histidine (i.e., Try31His) in a number of selected clones with preferential binding to CTLA-4, whereas all selected clones with preferential binding to CD28 retained the tyrosine at that position. Tyr-31 was also present at an equivalent position in all of the mature parental sequences. Tyr-31 of the mature CTLA-4BP and mature hB7-1 sequences corresponds to Tyr-65 of the full-length CTLA4-BP and hB7-1 sequences, respectively. Interestingly, it has been suggested that Tyr31 in human B7-2 may be replaced by phenylalanine without any apparent change in the ligand binding affinities (see, e.g., Freeman, G. J. et al. (1993) *Science* 262: 909–11); Azuma, M. et al. (1993) *Nature* 366:76–9), whereas a Tyr31Ala substitution in hB7-1 appears to completely abolish the binding of hB7-1 to both CD28 and CTLA-4 (see Peach, R. J. et al. (1995) *J Biol Chem* 270:21181–7). The present data demonstrate that the Tyr31His substitution, at least when present in the context of the shuffled CTLA-4BP sequence, does not significantly affect interaction with CTLA-4, whereas this mutation appears to contribute to the loss in binding to CD28, further supporting the suggestion that this residue plays an important role in the ligand binding of B7-1. Information regarding the three-dimensional structures of CD28BP and CTLA-4BP is useful in characterizing further the amino acid residues and structures that contribute to the preferential binding of NCSMs to their two respective ligands.

Sequence Round 2 CD28BP clones showed a range of amino acid and nucleotide diversity from wild-type B7-1 molecules. For example, the Round 2 CTLA4BP clones had a 93.8–96.9% amino acid identity with a WT B7-1 molecule and had a 96.2–97.7% identity at the nucleotide level.

The amino acid sequence of clone R2 CD28BP-15 differs from that of identical clones R2 CD28BP-3, -6, and -9 by only one amino acid residue at position 110; CD29BP-15 has a proline residue at position 110; clones CD28BP-3, -6, and -9 include a leucine residue at position 110.

The binding of labeled soluble ligand sCD28-Ig and sCTLA4-Ig to clones CD28BP-15 and CTLA-4BP 5x4-12c was further studied, as shown in FIGS. 9A–9H. Specifically, 293 cells were transiently (FIGS. 9A–9B) or stably (FIGS. 9C–9D) transfected with CD28BP-15 (solid circles) or hB7-1 (open squares), and with (dashed lines) and without (solid lines) a FLAG-tag. 293 cells were stably transfected with CTLA-4BP 5x4-12c (solid triangles) or WT hB7-1 (open squares) (FIGS. 9D–9E). Cells transiently (FIGS. 9A–9B) or stably (FIGS. 9C, 9D, 9E, 9F) transfected with a vector lacking a WT hB7-1, CD28BP or CTLA-4BP nucleic acid insert were used as negative controls (open diamonds). The transfectants were stained with increasing concentrations of labeled soluble CD28-Ig (FIGS. 9A, 9C, 9E) or soluble CTLA-4-Ig (FIGS. 9B, 9D, 9F), prepared as described above, and the cells were analyzed by flow cytometry. Stable 293 transfectants expressing CTLA-4BP 5x4-12c (gray histograms), hB7-1 (gray histograms) and negative control transfectants (open histograms) were stained with anti-hB7-1 mAbs (FIGS. 9G–9H), and the expression levels were analyzed by flow cytometry.

Staining of transfectants individually with sCD28-Ig or sCTLA-4-Ig indicated that CD28BP-15 transfectants bound sCD28-Ig at higher levels than transfectants expressing hB7-1 (as shown by increased MFI values), while sCTLA-4-Ig binding was significantly reduced, yet detectable (FIGS. 9A–9D) (as indicated by reduced MFI). On the other hand, little or virtually no binding of sCD28-Ig to CTLA-4BP 5x4-12c transfectants was detected even at high sCD28-Ig concentrations, while the same transfectants did bind sCTLA-4-Ig, although at somewhat lower levels than the transfectants expressing hB7-1 (FIGS. 9E–9F) (as shown by MFI values). The lack of binding of sCD28-Ig to CTLA-4BP 5x4-12c was not due to the lack of expression, as was determined by the binding of anti-hB7-1 monoclonal antibody (mAb) to the transfectants (FIGS. 9G–9H). In contrast to CTLA-4BP 5x4-12c, mAbs specific for hB7-1 did not recognize CD28BP (data not shown).

To analyze whether increased expression of CD28BP-15 on the transfected cells contributed to the improved binding of sCD28-Ig, we fused a FLAG-tag (see according to Brizzard, B. L. et al. (1994) *Biotechniques* 16:730–5) to hB7-1 and the shuffled clones, and the binding of a FLAG-specific mAb M2 (see id.) to the corresponding transfectants was studied. In seven separate transient transfections, the mean fluorescence intensity (MFI) of 293 cells transfected with CD28BP-FLAG and hB7-1-FLAG was 52±20 and 55±12, respectively (mean±SEM). Although no significant difference in the expression of the FLAG-constructs was observed, significantly improved binding of CD28-Ig was also observed using the FLAG-constructs (FIGS. 9A–9B), strongly suggesting the improved binding of sCD28-Ig by CD28BP-15 was due to improved affinity rather than improved expression of CD28BP-15.

We also analyzed the ligand binding properties of all starting B7-1 genes by two-color analysis using sCD28-Ig and sCTLA-4-Ig to illustrate that CD28BP-14 and CTLA-4BP 5x4-12c showed evidence of truly new properties. 293 cells transfected with human, rhesus monkey, orangutan, and baboon B7-1 genes exhibited essentially identical binding profiles to SCD28-Ig and sCTLA-4-Ig, whereas feline B7-1 showed little or no binding to sCD28-Ig or sCTLA-4-Ig (data not shown). Bovine and rabbit B7-1 transfectants demonstrated sCD28-Ig binding in the same range as that observed for human and primate B7-1, but their level of binding to sCTLA-4-Ig was somewhat lower. However, the binding level of sCTLA-4-Ig to CD28BP-15 was consistently less than that of any of the other starting genes; the mean MFIs of sCTLA-4-Ig binding to human (n=4), bovine (n=4), rabbit B7-1 (n=2), and CD28BP-15 (n=2) were 247, 102, 205, and 30, respectively. Thus, CD28BP-15 and CTLA-4BP 5x4-12c displayed properties that were unique as compared to any of the starting genes.

B. Functional Assays.

To investigate the functional properties of shuffled R2 CD28BP molecules, nucleic acid sequences corresponding to representative clones R2 CD28BP-1 to R2 CD28BP-17 were transfected into B7-negative cell lines and the capacity of the resulting transfectants to activate human T cells was analyzed (using T cell proliferation assays with $^3$H thymidine incorporation as described above). Representative results of selected clones are shown in FIG. 10. When used to costimulate T cells in soluble anti-CD3 induced proliferation assays, these selected clones induced a range of proliferative responses from slight induction (potential antagonist) to improved induction over human B7-1 (FIG. 10). At one end of the range, clone CD28BP-8 (amino acid SEQ ID NO:59), which was shown to bind CD28, induced low T cell proliferation as compared to the wild-type hB7-1. CD28BP-8 induced a T cell proliferation level slightly greater than that induced by cells transfected with an empty vector (lacking a B7-1, CD28BP, or CTLA-4BP nucleic acid insert). In contrast, CD28BP-15 induced a T cell proliferation response significantly greater than that induced by WT hB7-1 (FIG. 10). Other CD28BP clones induced a T cell proliferation response about equal to that induced by WT hB7-1.

The enhanced co-stimulation of purified human T cells by clone CD28BP-15 was further investigated as follows (FIGS. 11A–11C). 293 cells were transiently (FIG. 11A) or stably (FIG. 11B) transfected with CD28BP-15 nucleic acid, hB7-1 nucleic acid, or an empty control vector lacking the B7-1 or CD28BP-15 nucleic acid insert, and the irradiated transfectants were co-cultured with purified human T cells and anti-CD3 mAbs (to induce costimulation of T cells via the TCR) as described above. Mean±SEM (standard error of mean) of counts per minute (C.P.M.) ($^3$H thymidine incorporation) obtained in three (FIG. 11A) or six (FIG. 11B) independent experiments are shown.

Figure 11A:
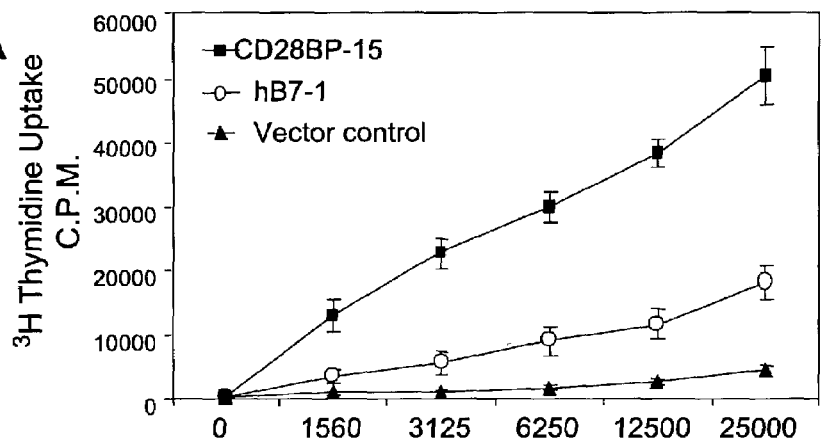
FIGS. 11A–11C present graphs illustrating improved co-stimulation of purified human T cells observed co-culturing irradiated 293 cells transiently (A) or stably (B) transfected with clone CD28BP-15, hB7-1, or a control vector with purified T cells and anti-CD3 mAbs.
Figure 11B:
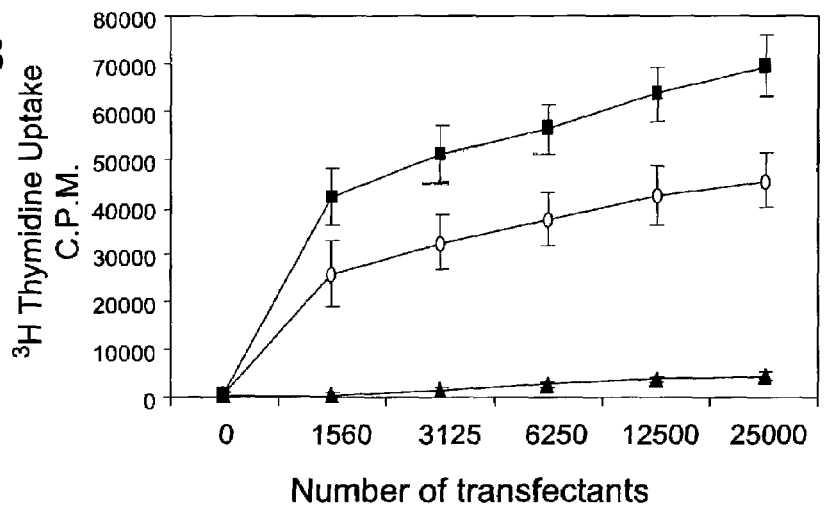

CD28BP-15 transfectants induced greatly increased proliferation of purified human T cells cultured in the presence of anti-CD3 mAbs compared to cells transfected with hB7-1 (FIG. 11A). Moreover, we generated stable transfectants of CD28BP-15 and hB7-1 by selecting clones that expressed similar levels of the NCSM molecules based on binding of sCD28-Ig at saturating concentrations. Similar to transient transfectants, stable transfectants expressing CD28BP-15 induced a more potent T cell proliferation than those transfectants expressing hB7-1 (FIG. 11B).

Figure 11C:
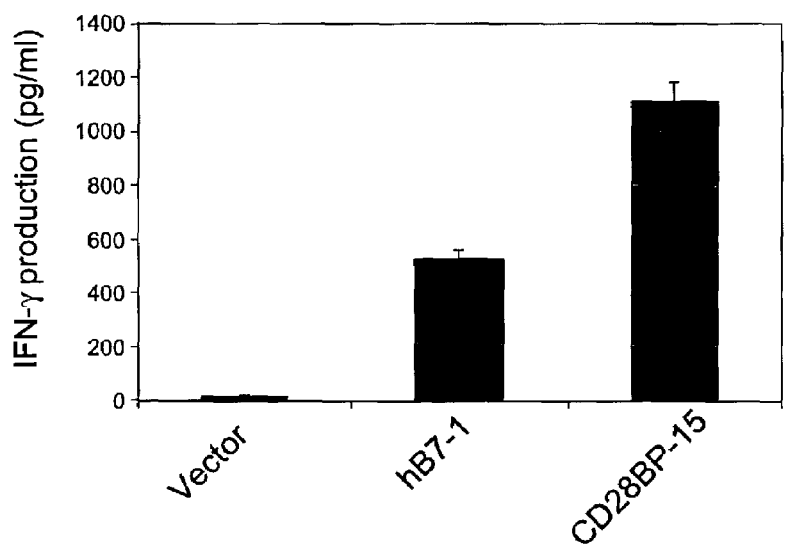

Irradiated stable transfectants expressing CD28BP-15 or hB7-1 and negative control cells transfected with a vector lacking the insert were co-cultured with purified human T cells, and the levels of IFN-gamma production were measured after a culture period of 48 hours. A representative experiment is shown in FIG. 11C; similar data were obtained in three other experiments. Production of IFN-gamma in response to transfectants expressing CD28BP-15 was higher than that induced by hB7-1 transfectants (FIG. 11C). Approximately 10-fold fewer transient or stable transfectants expressing CD28BP-15 than those expressing hB7-1 were required to obtain a similar level of human T cell proliferation. Importantly, the maximum levels of T cell proliferation and IFN-gamma production were also increased (FIG. 11C). We believe these results are likely attributable to the lack of negative signaling through CTLA-4. The increased affinity to CD28 and reduced affinity to CTLA-4 appears to have contributed to the CD28BP-15-mediated improved T cell response.

Figure 12:
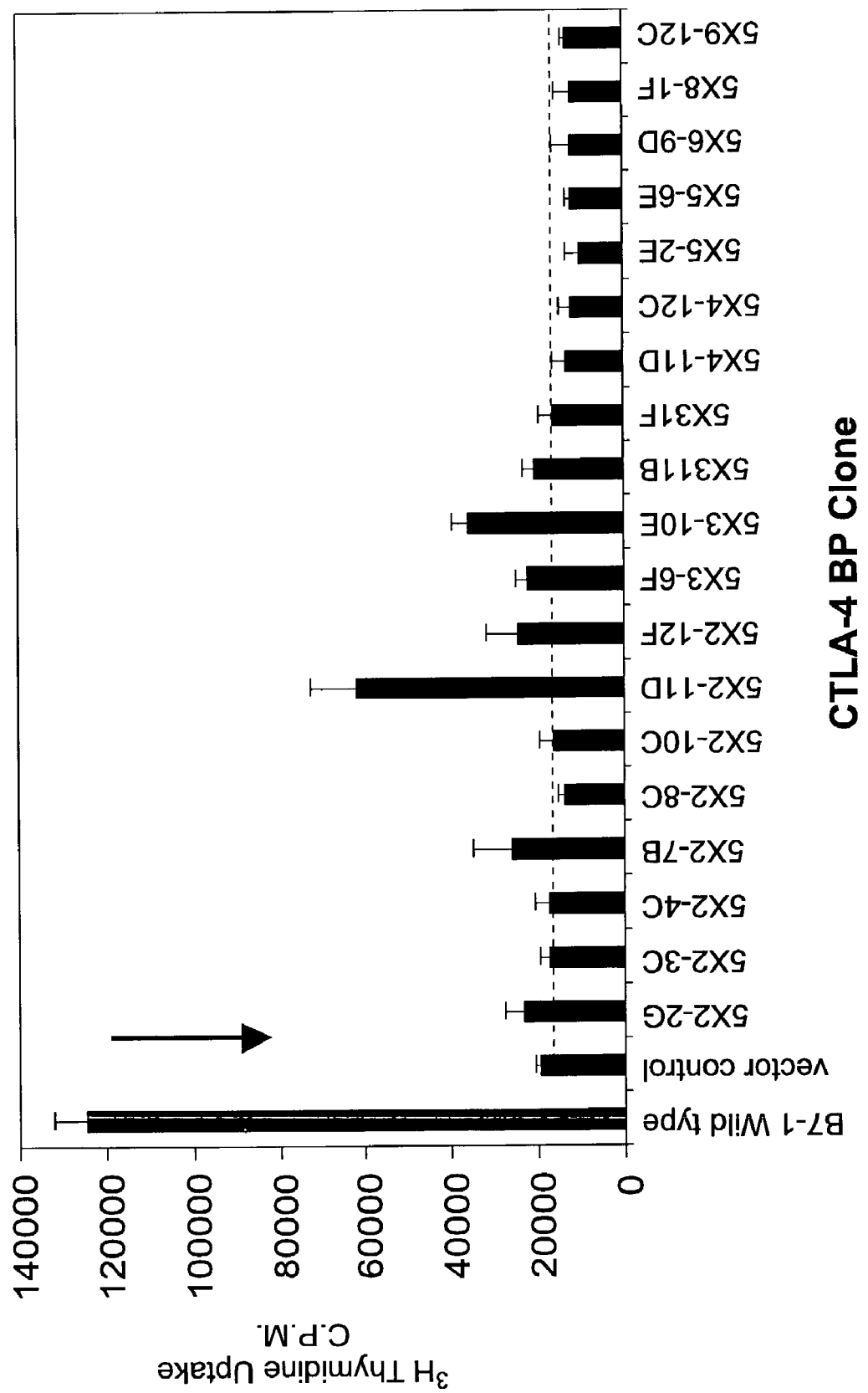
FIG. 12 shows a graph depicting T cell proliferation response, as measured by $^3$H thymidine incorporation, resulting from the co-culturing of cells transfected with one of nineteen CTLA-4BP clones, WT human B7-1 (CD80), or an empty control vector cultured with soluble anti-CD3 mAbs.

The effect of Round 2 CTLA-4BP clones on purified T cells in T cell proliferation assays was investigated. In a representative T cell proliferation study performed as described above, 19 selected clones of the R2 library (designated as CTLA4BP-1 through CTLA4BP-19) having reduced binding to CD28, but relatively strong binding to CTLA-4, were found to reduce T cell proliferation in a soluble anti-CD3 induced T cell proliferation assay (see FIG. 12) compared to that induced by wild-type hB7-1. Cells transfected with an empty vector (lacking a B7-1 or CTLA-4BP nucleic acid insert), were used as the control. These selected CTLA-4BP clones produced a range of responses from reduced or suppressed induction of T cells relative to hB7-1 induction, to a significant inhibition of T cell proliferation (FIG. 12).

The effect of exemplary clone CTLA-4BP 5x4-12c on purified T cells and on T cell proliferation and cytokine synthesis induced in MLR was further investigated. Representative results are shown in FIGS. 13A–13D. In the co-stimulation experiments, purified T cells were co-cultured in the presence of soluble anti-CD3 mAbs (5 micrograms/ml) and transient transfectants expressing hB7-1, CD28BP-15, CTLA-4BP 5x4-12c, or a vector control lacking the expressed sequence (FIG. 13A); a representative experiment is shown. Similar data were obtained in two other experiments. Increasing numbers of 293 cells stably transfected with CTLA-4BP 5x4-12c nucleic acid (solid triangles), hB7-1 nucleic acid (open squares), or a control vector lacking a B7-1, CTLA-4BP, or CD28BP nucleic acid insert (open diamonds) were added to the MLR cultures, as shown in FIG. 13B. The data represent mean±SEM of C.P.M. obtained in six separate MLR cultures, each performed using 4–6 replicate wells. MLR was cultured in the presence of 25000 irradiated 293 cells stably transfected with hB7-1, CTLA-4BP 5x4-12c or a control vector without an insert, as shown in FIGS. 13C–13D. IFN-gamma and IL-10 levels were measured by ELISA after an MLR culture period of 48 hours (FIGS. 13C–13D). Six independent experiments were performed and the values obtained within one experiment are connected with a solid line. The production levels of IFN-gamma significantly increased (P<0.05) and those of IL-10 significantly decreased (P<0.01) for CTLA-4BP 5x4-12c compared to hB7-1 or vector control (paired Student's t-test).

Figure 9A:
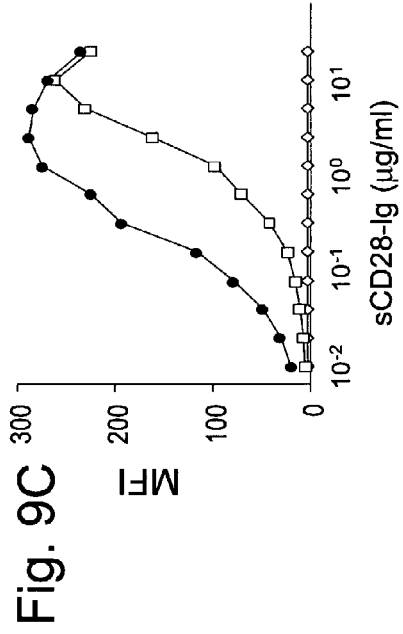
FIGS. 9A–9F are graphs depicting the mean fluorescence intensities generated by the binding of labeled soluble ligand sCD28-Ig and labeled soluble ligand sCTLA4-Ig to clones CD28BP-15 and CTLA-4BP 5x4-12c.
Figure 9B:
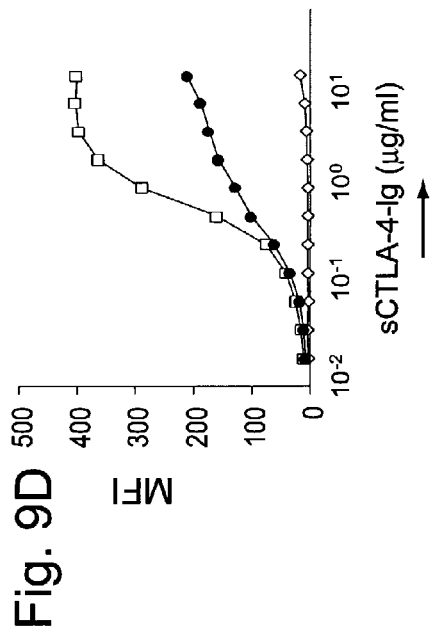
Figure 9C:
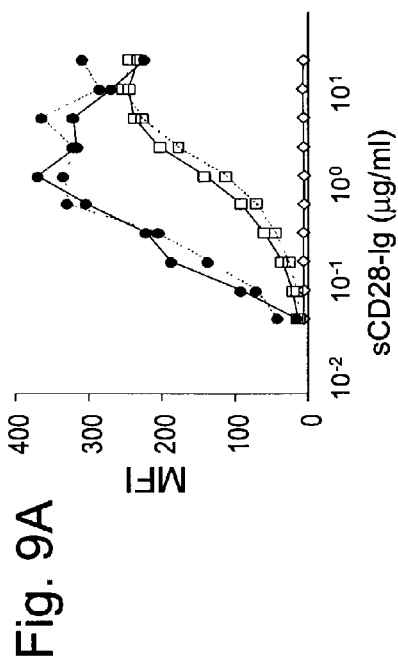
Figure 9D:
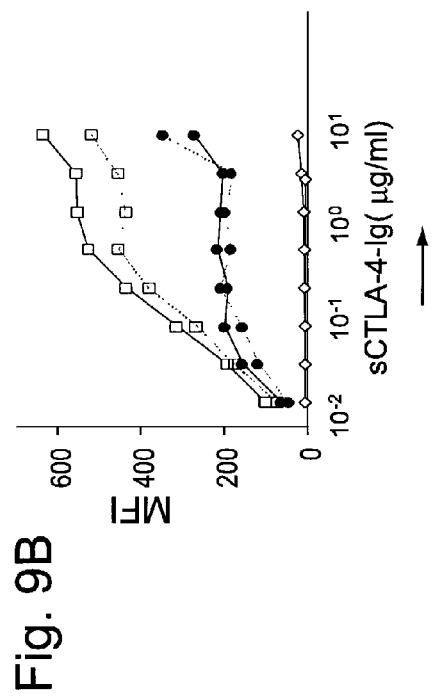
Figure 9E:
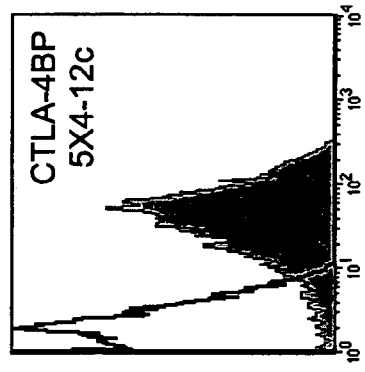
Figure 9F:
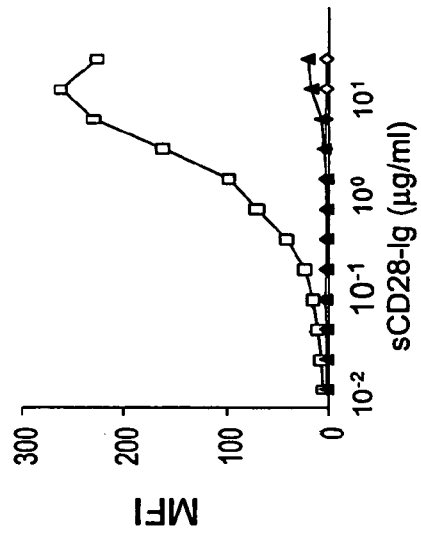
Figure 9G:
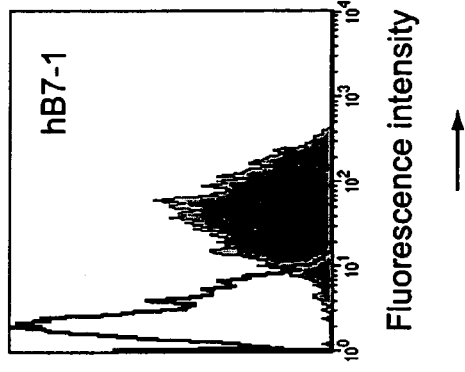
FIGS. 9G–9H provide graphs illustrating histograms from the staining of stable 293 transfectants expressing CTLA-4BP 5x4-12c (gray histograms), hB7-1 (gray histograms) and negative control transfectants (open histograms) with anti-hB7-1 monoclonal antibodies (mAbs) with expression levels analyzed by flow cytometry.
Figure 9H:
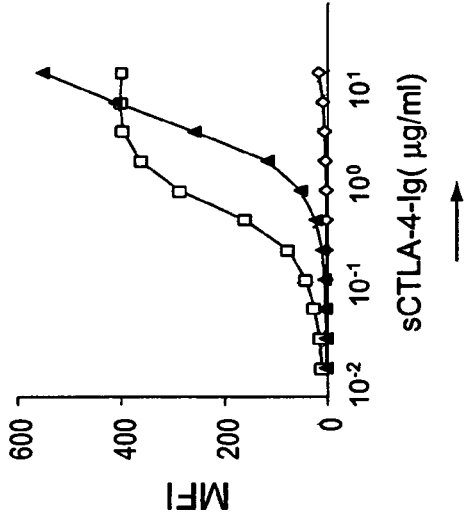
Figure 13A:
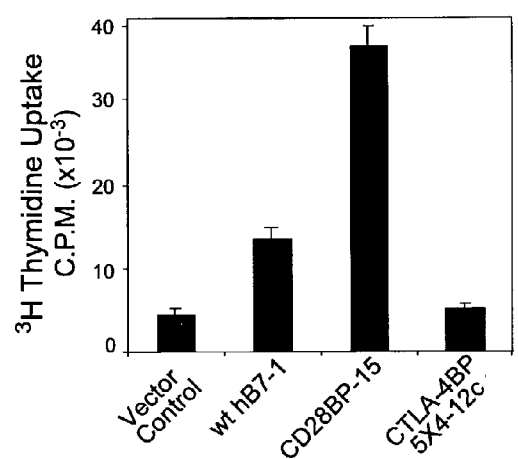
FIGS. 13A–13D show graphs illustrating the effects of cells transfected with clone CTLA-4 BP 5x4-12C, hB7-1 or a control vector cultured on T cell proliferation induced by co-culturing the transfectants with purified T cells in the presence of soluble anti-CD3 mAbs and on cytokine synthesis in mixed lymphocyte reaction assay.
Figure 13B:
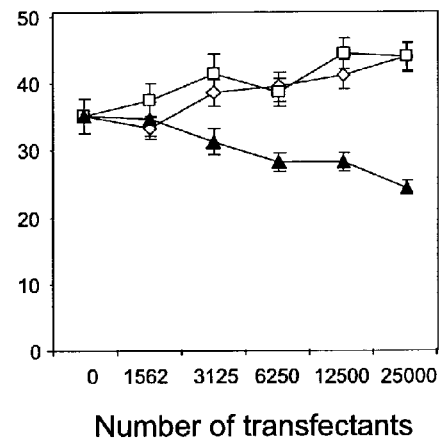
Figure 13C:
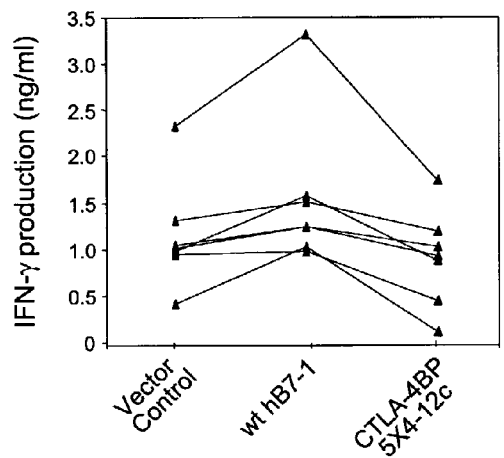
Figure 13D:
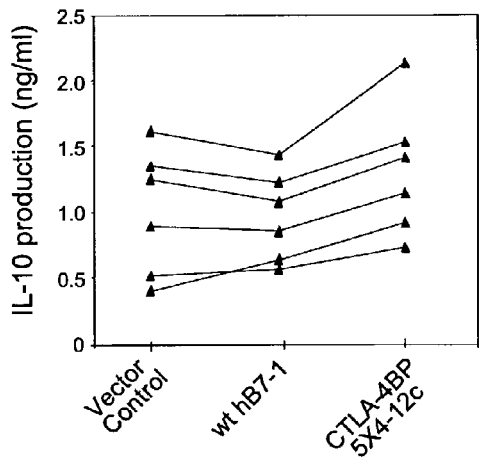

Relative to CD28BP-15, hB7-1, and a control vector, CTLA-4BP 5x4-12c exhibited very little ability to co-stimulate human T cells cultured in the presence of soluble anti-CD3 mAbs (FIG. 13A). No co-stimulation of human T cells was induced by either transient or stable CTLA-4BP 5x4-12c transfectants, although efficient expression of the molecule on the surface of the transfectants was observed using anti-B7-1 mAbs (see FIGS. 9G–9H, FIG. 13A, and data not shown). In fact, only 2 of 19 selected Round 2 clones (from Group I of the second round of recombination) that displayed preferential binding to CTLA-4 over CD28 had the capacity to induce a T cell response that was more than 10% of that induced by hB7-1 (data not shown), illustrating the lack of sCD28-Ig binding to these clones correlated with the lack of signaling through CD28.

More importantly, CTLA-4BP 5x4-12c transfectants inhibited T cell proliferation induced in a mixed lymphocyte reaction (MLR) in a dose-dependent manner (FIG. 13B). Moreover, CTLA-4BP 5x4-12c transfectants induced IL-10 production in MLR, but reduced IFN-g production, compared to hB7-1 or control transfectants (FIGS. 13D and 13C, respectively), further supporting the notion that CTLA-4BP 5x4-12c has a dramatically altered biological function as compared to hB7-1. Several studies have suggested supporting roles for CTLA-4 (see, e.g., McAdam, A. J. et al. (1998) *Immunol Rev* 165:231–47; Waterhouse, P. et al. (1995) *Science* 270:985–8; Perez, V. L. et al. (1997) *Immunity* 6:411–7; Shrikant, P. et al. (1999) *Immunity* 11:483–93; van Elsas, A. et al. (1999) *J Exp Med* 190:355–66; Greenwald, R. et al. (2001) *Immunity* 14:145–155) and IL-10 (see, e.g., Groux, H. et al. (1997) *Nature* 389:737–42; Rizzo, L. V. et al. (1999) *J Immunol* 162:2613–22) in inducing and maintaining immunological tolerance. The results of the present invention also suggest that CTLA-4BPs of the invention, including, e.g., CTLA-4BP 5x4-12c, are useful in down-regulating the function of specific T cells in autoimmune diseases and the like, and are thus of benefit in therapeutic and prophylactic methods for treating such diseases.

Previous studies on B7 mutants showed that binding sites for CD28 and CTLA-4 are largely overlapping and that mutations in B7 that affected the binding to one ligand (i.e., CD28 or CTLA-4) generally also affected the binding to the other ligand. However, only a limited number of variants were tested and they were generally designed based on information of expected ligand binding sites. For example, in contrast to the present results, mutations of human B7-1

(hB7-1) that were previously designed based on structural information and predicted receptor binding sites generally produced equivalent effects on binding to CD28 and CTLA-4 (see, e.g., Peach, R. J. et al. *J Biol Chem* 270, 21181–7 (1995). The current data show that the frequency of functional variants with altered ligand binding properties is sufficiently high enough that a desired phenotype may be rapidly identified using the appropriate selection criteria and screening procedures. Thus, appropriate screening of the sequences produced by recombination of known mammalian genomes serves as an effective means to identify those recombined sequences having novel functional properties without detailed knowledge of the receptor binding sites or the structures of the proteins. These results illustrate the advantages of the crossbreeding of mammalian genes of different species to evolve proteins having novel functional properties. CD28BP and CTLA-4BP may also help in further deducing the mechanisms by which CD28 and CTLA-4 trigger positive and negative signals to T cells, respectively. The fact that B7-1 and B7-2 naturally bind to both CD28 and CTLA-4 has limited the potential scope of their clinical applications. The chimeric CD28BP and CTLA-4BP molecules described herein have wide-ranging clinical applications; they are useful, for example, in the manipulation of T cell responses in vitro and in vivo in a variety of pharmaceutical and medical applications and vaccinations.

Example IV

Production of Soluble NCSM Polypeptides and Fusion Proteins and Nucleic Acids Encoding Them The present invention also provides soluble NCSM polypeptides, and subsequences and fragments thereof that encompass a variety of formats, described herein, including, but not limited to, e.g., at least one of an extracellular domain (ECD), of a NCSM polypeptide or a fragment, variant or homologue thereof, and an NCSM-ECD-Ig fusion protein or fragment, variant, or homologue thereof; and nucleotide and polynucleotide sequences encoding all such polypeptides, proteins, fragments, homologues, and variants.

A soluble form of an NCSM polypeptide is useful in in vivo, ex vivo, or in vitro methods, including, e.g., therapeutic or prophylactic treatment or diagnostic methods, administered as either a DNA plasmid expression vector (e.g., DNA vaccine; gene therapy applications) or protein, for treating or preventing various immunological disorders and diseases, including, e.g., cancers, including, but not limited to, e.g., colorectal cancer, breast cancer, pancreatic cancer, lung cancer, prostate cancer, naso-pharyngeal cancer, cancer, brain cancer, leukemia, melanoma, head- and neck cancer, stomach cancer, cervical cancer, ovarian cancer, lymphomas, colon cancer, colorectal); allergy/asthma, autoimmune diseases, organ transplantation (e.g., graft versus host disease, and autoimmune diseases), chronic infectious diseases, including, but not limited to, e.g., viral infectious diseases, such as those associated with, but not limited to, e.g., hepatitis B virus (HBV), herpes simplex virus (HSV), hepatitis C virus (HCV), HIV, human papilloma virus (HPV), and the like, and bacterial infectious diseases, such as, but not limited to, e.g., Lyme disease, tuberculosis, and chlamydia infections; and other diseases described herein for non-soluble NCSMs of the invention, and as vaccine adjuvants in vaccine applications as described for non-soluble NCSMS. Soluble NCSMs are also useful for diagnostic purposes, as for in vitro applications for testing and diagnosing such diseases.

In this example, selected CD28BP and CTLA-4BP clones were used for the preparation of corresponding soluble CD28BP and CTLA-4BP polypeptides and nucleic acids encoding such polypeptides. A CD28BP ECD polypeptide or fragment thereof may have a CD28/CTLA-4 binding affinity ratio equal to or greater than the CD28/CTLA-4 binding affinity ratio of hB7-1, and other biological properties described below; a CTLA-4BP ECD polypeptide of fragment thereof may have a CD28/CTLA-4 binding affinity ratio equal to or greater than that of hB7-1, and other biological properties described below.

A. Expression Vectors Encoding Soluble ECDs of NCSM Polypeptides

Mammalian expression plasmids encoding soluble (non-membrane bound) extracellular domains (sECDs) of NCSM polypeptides (or fragments thereof) were constructed by PCR amplification using pfu turbo polymerase (Stratagene, La Jolla, Calif.) of selected NCSM ECDs from plasmids containing a selected full-length NCSM DNA sequence. The PCR primers were designed to specifically anneal with the first or last 20–24 nucleotides of a particular nucleic acid region corresponding to a NCSM ECD (or fragment thereof), and flanked by restriction sites NheI and NotI, at their 5' and 3' ends, respectively. Amplicons of ~730 base pairs (bp) (specific base pair numbers for each clone are shown in Table 5) encoding individual ECDs (or fragments thereof) were digested with NheI and NotI (New England BioLabs, Beverly, Mass.), subsequently purified by low melt agarose gel electrophoresis (see procedure described in Sambrook, supra). A pcDNA3.1 (+) expression plasmid (Invitrogen, Carlsbad, Calif.), which was used as the backbone vector, was digested with NotI and ApaI restriction enzymes and fused (ligated) in-frame to a nucleic acid sequence encoding a carboxy-terminal epitope fusion tag comprised of the E-epitope (Amersham Pharmacia Biotech) and hexa-His tag using standard cloning procedures. This vector fragment was then digested with NheI and NotI and to an ~5400 bp NheI-NotI fragment comprising the vector backbone and E-epitope/His-tag fusion sequence. This vector fragment was gel purified and ligated to each ~730 bp NheI-NotI NCSM ECD polynucleotide to produce soluble ECD NCSM expression plasmids. Mammalian expression plasmids encoding a soluble ECD form of wild-type human B7-1 were similarly prepared from plasmids containing the full-length WT human B7-1 DNA sequence.

TABLE 5

| Clone ID | Nucleotide Position | Amino Acid Position | 3' end ECN |
|---|---|---|---|
| wild-type huB7.1-ECD | 1–726 | 1–242 | PDN |
| CD28BP-8 ECD | 1–735 | 1–245 | IDQ |
| CD28BP-11 ECD | 1–732 | 1–244 | IDQ |
| CD28BP-15 ECD | 1–735 | 1–245 | IDQ |
| CTLA4-5X2-8C ECD | 1–726 | 1–242 | PDN |
| CTLA4-5X2-10C ECD | 1–726 | 1–242 | PDN |
| CTLA4-5X4-1F ECD | 1–726 | 1–242 | PDN |
| CTLA4-5X4-11D ECD | 1–726 | 1–242 | PDN |
| CTLA4-5X4-12C ECD | 1–726 | 1–242 | PDN |
| CTLA4-5X5-2E ECD | 1–726 | 1–242 | PDN |
| CTLA4-5X5-6E ECD | 1–726 | 1–242 | PDN |
| CTLA4-5X6-9D ECD | 1–726 | 1–242 | PDN |
| CTLA4-5X8-1F ECD | 1–726 | 1–242 | PDN |
| Clone ID | Nucleotide Position | Amino Acid Position | 5' end Fc |
| P01857 Hu IgG1-Fc | 298–690 | 100–230 | PKSCDKTH . . . |

Table 5 shows for positions of nucleotide residues and corresponding amino acid residues of the signal peptide sequence and representative ECD domains of selected CD28BP and CTLA-4BP clones, and equivalent positions in WT hB7-1 ECD, and the last three amino acid residues at the 3' end of each ECD of a selected NCSM clone or WT hB7-1. The present invention provides for ECD domains of the NCSM polypeptides (and nucleic acid sequences encoding such polypeptides) that lack the signal peptide sequence, such that the first 34 amino acids (or 102 nucleic acids encoding same) of each NCSM ECD polypeptide (or nucleic acid encoding said polypeptide) are absent.

Figure 14A:
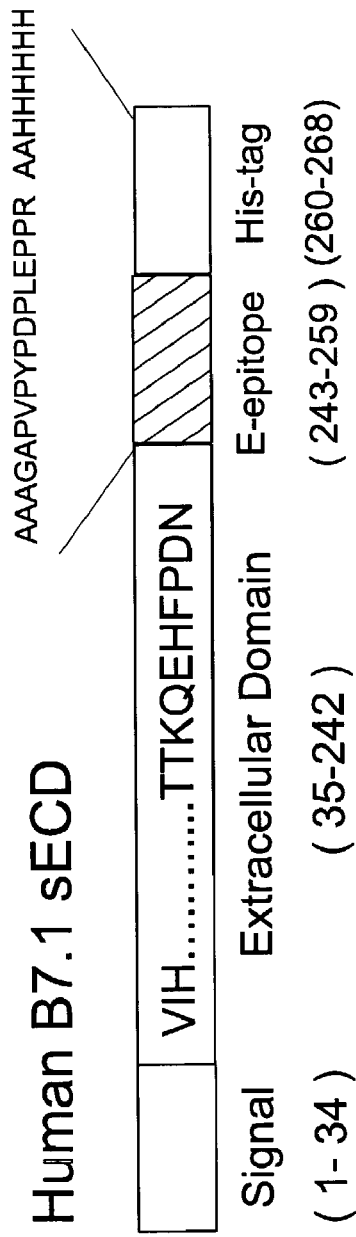
FIGS. 14A–14B are schematic representations of exemplary soluble forms of human B7-1 molecules. Expression plasmids were constructed by juxtaposing the nucleotide sequence encoding a signal sequence and extracellular domain (ECD) (or ECD fragment) of WT hB7-1 with a nucleotide sequence encoding E epitope and/or His Tag or human Ig Fc domain to create a IgG fusion protein.

FIG. 14A shows a schematic representation of a hB7-1-ECD fused to an E-epitope amino acid sequence and a hexa-His tag amino acid. The amino acid sequences corresponding to the E-epitope and hexa-His tag, and selected amino acids of the ECD, are shown.

Figure 15:
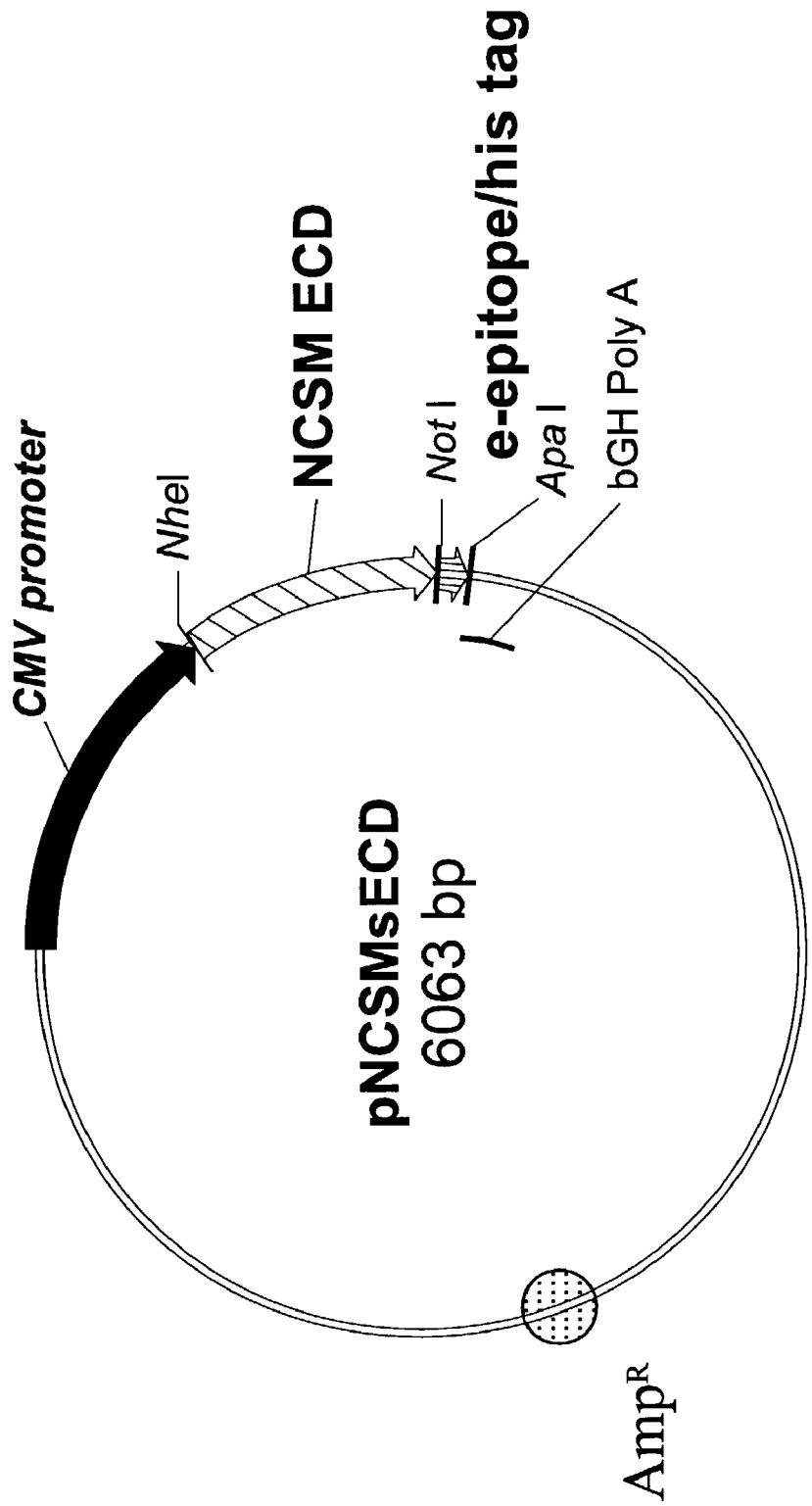
FIG. 15 illustrates an example of a pNCSMsECD plasmid expression vector comprising a nucleotide sequence encoding a soluble extracellular domain of a NCSM polypeptide of the invention with an E-epitope tag and/or histidine tag.

A representative plasmid expression vector, termed pNSCMsECD, comprising 6063 bps and encoding a soluble NCSM ECD, made by the above procedure is shown in FIG. 15. The vector includes, among other things, selected elements of the pCDNA3.1(+) backbone, including an ampicillin resistant gene, $A^R$, and a bovine growth hormone (bGh) poly A termination sequence; nucleic acid sequence encoding an E-epitope/his tag; nucleic acid sequence encoding a NCSM-ECD; and a CMV promoter (e.g., known or WT CMV promoter, such as human CMV promoter, or recombinant or chimeric CMV promoter). A plasmid vector encoding a soluble hB7-1-ECD or fragment thereof can be made by substituting a hB7-1-ECD sequence or fragment thereof for the NCSM-ECD sequence shown in the figure.

A plasmid expression vector encoding either a soluble NCSM-truncated ECD (e.g., NCSM ECD fragment) or a soluble WT hB7-1-trunECD can be made using the procedure above by substituting a truncated NCSM ECD nucleic acid sequence or truncated hB7-1 ECD nucleotide sequence for NCSM ECD nucleotide sequence. Table 6 shows the positions of nucleotide residues and corresponding amino acid residues of the signal peptide sequence and exemplary truncated ECD domains of selected CD28BP and CTLA-4BP clones and WT hB7-1 ECD, and the last three amino acid residues at the 3' end of each truncated ECD of a NCSM clone or WT hB7-1.

TABLE 6

| Clone ID | Nucleotide Position | Amino Acid Position | 3' end ECN |
|---|---|---|---|
| wild-type huB7.1-ECD | 1–702 | 1–234 | NTT |
| CD28BP-8 ECD | 1–717 | 1–237 | SKP |
| CD28BP-11 ECD | 1–717 | 1–237 | SKP |
| CD28BP-15 ECD | 1–717 | 1–237 | SKP |
| CTLA4-5X2-8C ECD | 1–702 | 1–234 | NTP |
| CTLA4-5X2-10C ECD | 1–702 | 1–234 | NTP |
| CTLA4-5X4-1F ECD | 1–702 | 1–234 | NTP |
| CTLA4-5X4-11D ECD | 1–702 | 1–234 | NTP |
| CTLA4-5X4-12C ECD | 1–702 | 1–234 | NTP |
| CTLA4-5X5-2E ECD | 1–702 | 1–234 | NTP |
| CTLA4-5X5-6E ECD | 1–702 | 1–234 | NTT |
| CTLA4-5X6-9D ECD | 1–702 | 1–234 | NTP |
| CTLA4-5X8-1F ECD | 1–702 | 1–234 | NTP |

| Clone ID | Nucleotide Position | Amino Acid Position | 5' end Fc |
|---|---|---|---|
| X70421 Hu IgG1-Fc | 85–768 | 29–256 | DKTH . . . |

The invention also provides for ECD domains of the NCSM polypeptides (and nucleic acid sequences encoding such polypeptides) that lack the signal peptide sequence; the first 34 amino acids (or 102 nucleic acids encoding same) of each NCSM ECD polypeptide (or nucleic acid encoding a NCSM ECD polypeptide) are absent. In secreted forms, the signal sequence is cleaved.

B. Expression and Purification of Soluble ECD and NSCM Polypeptides.

Figure 16:
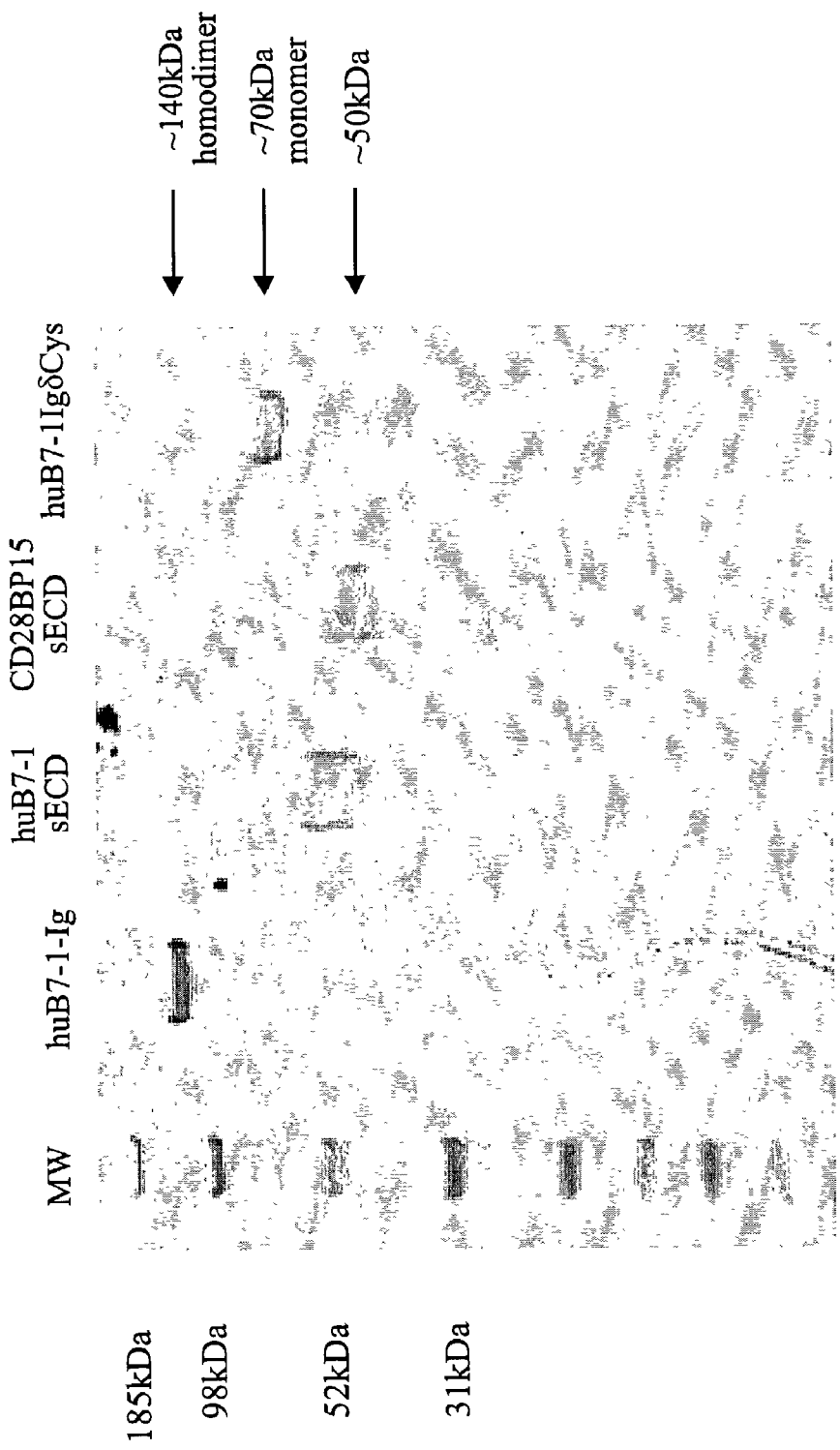
FIG. 16 is a photographic representation of a sodium dodecylsulfate polyacrylamide gel electrophoresis (SDS-PAGE) analysis of various soluble forms of WT B7-1 (ECD and fusion protein and delta Cys mutant) and clone CD28BP-15. Molecular weight standards are shown on the left for comparison.

Soluble polypeptides from the CTLA-4BP-ECD, CD28BP-ECD, and hB7-1-ECD expression vectors described above was expressed by transfection of these vectors into cells of a human HEK 293 cell line using Superfect Reagent (Qiagen) and expression of the sequence encoding the NCSM ECD or a fragment thereof. In each case, soluble protein was purified from crude culture supernatants using a Hi-Trap anti-e-epitope mAb affinity column (Amersham-Pharmacia, Piscataway, N.J.) followed by buffer exchange into PBS, according to the manufacturer's instructions. Purity of a recovered fusion protein was assessed by SDS-PAGE followed by either coumassie stain or immunoblotting with a mouse anti-penta-His mAb (Serotech, UK), performed according to manufacturer's instructions and using known methods as described in, e.g., Rapley and Walker; Harlow and Lane; Colligan; Sambrook, all supra (data not shown). The SDS-PAGE results for soluble hB7-1-ECD and soluble CD28BP-15 sECD revealed a molecular weight (MW) of ~50 kDa for each, as shown in FIG. 16. A reference mixture spotted in the far-left lane indicated bands of compounds of known MWs of 188 kiloDaltons (kDa), 98 kDa, 56 kDa, and 31 kDa, respectively, for comparison. SDS-PAGE analysis showed a hB7-1-Ig fusion protein homodimer of ~140 kDa; this dimer is believed to contain a covalent linkage between cysteine residues of the hinge-CH2-CH3 domain of the Fc. A hB7-1-Ig monomer thus would have an apparent MW of ~70 kDa. A ~70-kDa monomer of hB7-1-Ig-delta Cys mutant fusion protein was also observed (see FIG. 16). It is believed the deleted cysteine (δCys) mutant prevents covalent dimerization of two individual B7-1-ECD/hinge-CH2-CH3 (Ig) molecules.

C. Expression Vectors Encoding Soluble NCSM-IG Fusion Proteins.

Figure 14B:
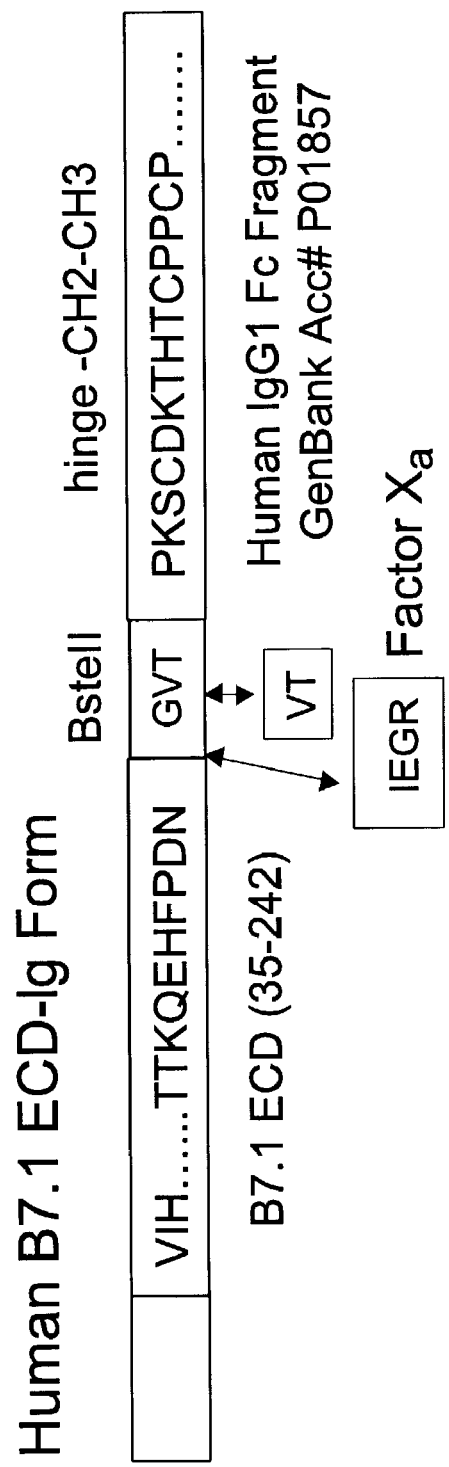

Mammalian expression plasmids encoding a soluble NCSM-ECD-Ig fusion protein and soluble WT hB7-1-ECD-Ig fusion protein were constructed first by PCR amplification using pfu turbo polymerase (Stratagene, La Jolla, Calif.) of selected NCSM ECDs or hB7-1-ECD from plasmids containing a full-length NCSM DNA sequence and hB7-1 DNA sequence as described above. The PCR primers were designed to anneal specifically with the first or last 20–24 nucleotides of a particular nucleic acid region corresponding to the ECD of a specific NCSM or hB7-1, and flanked by restriction sites BamHI and BsteII, at their 5' and 3' ends, respectively. In some instances, the small peptide linker forming the in-frame translational coupling between the NCSM ECD (or hB7-1) and the IgG1 Fc contained the sequences valine-threonine (VT) or glycine-valine-threonine (GVT), depending upon the nucleotide sequence compatibility of the 3' codon of the NCSM ECD. Incorporation of the BsteII restriction site at the fusion junction creates the in-frame valine-threonine linker. The factor Xa cleavage site (IEGR) was inserted between the 3' end of the NCSM ECD (or hB7-1 ECD) and 5' end of the GVT or VT linker to allow production of sECD void of the Fc domain (FIG. 14B).

DNA sequences encoding human IgG1 Fc were obtained from human spleen mRNA (Clontech, Palo Alto, Calif.) using a RT-PCR kit (Stratagene, La Jolla, Calif.) according to the manufacturer's instructions, and primers specific to the first or last 20–28 nucleotides of the sequence corresponding to the entire human IgG1 Fc hinge domain or a fragment thereof (see, e.g., the protein sequences shown at Genbank Accession Nos. P01857 and X70421, respectively; other Fc sequences can also be used) flanked by restriction sites BstEII and EcoRI, at their 5' and 3' ends, respectively (FIG. 14B). Alternatively, a variant derived from a human IgG1 Fc hinge domain (e.g., Genbank Access. No. P01857 or X70421) can be prepared that imparts specific desirable biological and pharmacological properties to the soluble NCSMs.

The IgG1-Fc amplicon (~730 bp) was digested with BstEII and EcoRI and subsequently cloned into pCDNA3.1 (+) expression vector (serving as a backbone vector) digested with BamHI and EcoRI. The NCSM-Ig expression plasmids were constructed by ligating (fusing in-frame) low melt agarose purified NCSM BamHI-BstEII DNA fragments (~730 bp), Ig-Fc BstEII-EcoRI DNA fragments (~730) and pCDNA3.1(+) BamHI-EcoRI DNA fragment (~5400 bp) to produce soluble NCSM-ECD-IgFc fusion expression vectors (see FIG. 17).

A sequence complementary to either that corresponding to the sequence shown at GenBank Accession No. X70421 or P01857 and an IgG Fc variant containing two amino acid substitutions (D234E and L241M) were cloned and deduced by DNA sequence analysis using known methods. The NCSM-Ig fusions proteins may contain an IgG Fc sequence corresponding to that shown at GenBank Accession No. X70421 or P01857 or IgG Fc variant sequence as the fusion partner.

FIG. 14B shows a representation of a soluble WT human B7-1-ECD-Ig sequence, including the signal domain, ECD, Factor Xa (IEGR), VT or GVT linker, and human B7 hinge CH2-CH3 domain of the Fc region of IgG1 corresponding to the sequence shown at GenBank Accession No. P01857. The amino acid residues positioned at the beginning and end of a representative ECD domain and 5' end of the human B7 hinge CH2-CH3 domain are shown. A NCSM-ECD-Ig sequence would be comparable to that shown for hB7-1ECD-Ig in FIG. 14B.

Nucleotide sequences encoding truncated NCSM ECDs or truncated hB7-1ECDs were also used to make NCSM-trunECD-Ig and hB7-1-trun ECD-Ig expression constructs and fusion proteins, respectively. Truncated NCSM ECDs typically contained at least one less amino acid residue than the full-length NCSM ECD; nucleotide sequences encoding truncated NCSM ECDs comprised corresponding fewer nucleotides.

The nucleotide positions and corresponding amino acid positions of an exemplary full-length ECD or truncated ECD of selected NCSM clones and hB7-1 used for construction of expression plasmids encoding the fusion proteins are shown in Tables 5 and 6. Table 5 shows the nucleotide positions and corresponding amino acid positions of the hIgG1 Fc sequence shown at GenBank Accession No. P01857, and amino acid residues at the 5' end of this Fc region. Table 6 shows the nucleotide positions and corresponding amino acid positions of the hIgG1 Fc sequence at GenBank Accession No. X70421, and amino acid residues at the 5' end of this Fc region. The invention also provides for fusion proteins in which the ECD domains of the NCSM polypeptides (and nucleic acid sequences encoding such polypeptides) lack the signal peptide sequence; in this aspect, the first 34 amino acids (or 102 nucleic acids encoding same) of each NCSM ECD polypeptide (or nucleic acid encoding NCSM ECD polypeptide) is absent. In secreted forms, the signal sequence is cleaved.

Figure 17:
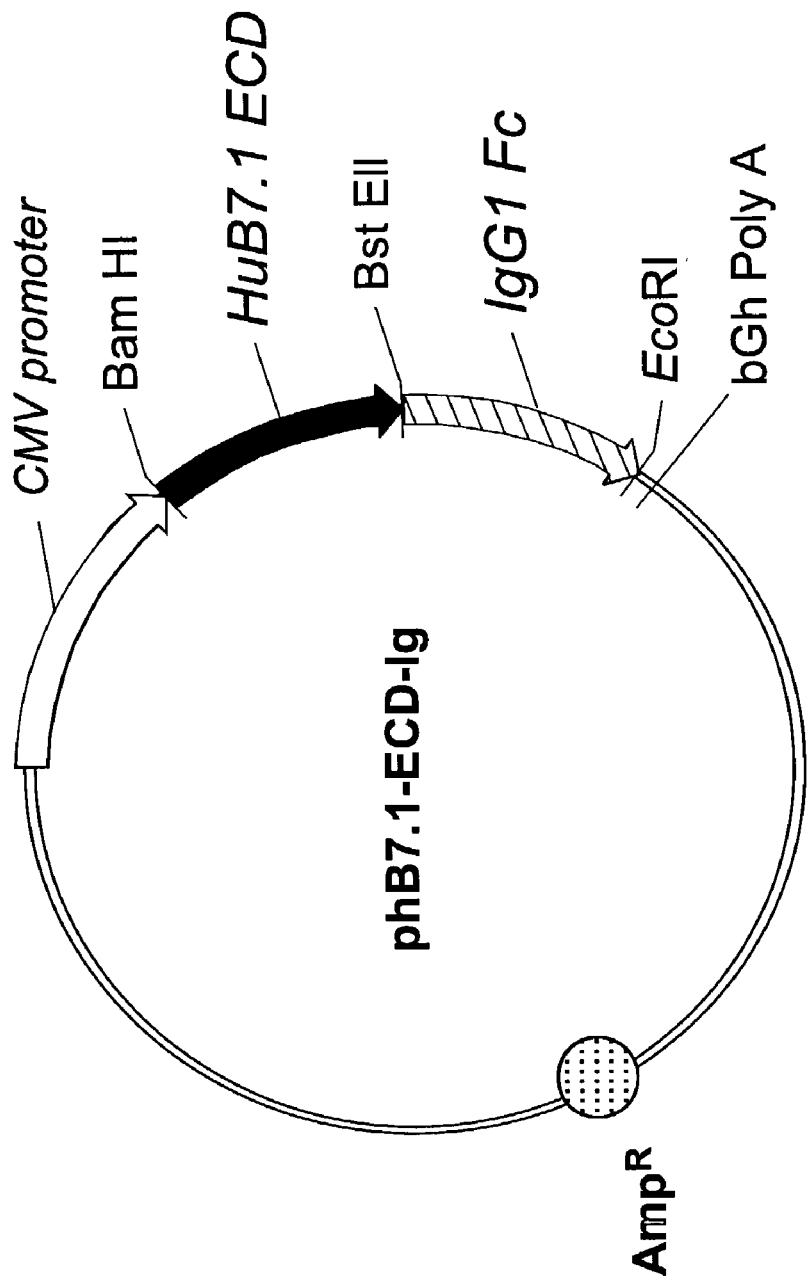
FIG. 17 illustrates an example of a phB7-1ECD-Ig plasmid expression vector comprising a nucleotide sequence encoding a soluble extracellular domain of a human B&-1/IgG1 Fc domain fusion protein. A nucleotide sequence encoding the extracellular domain of a NCSM polypeptide (or fragment thereof) can be substituted for the human B7-1-ECD sequence.

A representative plasmid vector encoding a soluble hB7-1-ECD-Ig fusion protein, phB7-1-ECD-Ig, is shown in FIG. 17. The vector includes, among other things, selected elements of the pCDNA3.1(+) backbone, including an ampicillin resistant gene, $A^R$, and a bovine growth hormone (bGh) poly A termination sequence; nucleic acid sequences encoding a hB7-1-ECD/IgG1 Fc fusion protein; and a CMV promoter (e.g., known or WT CMV promoter, such as human CMV promoter, or recombinant or chimeric CMV promoter). A plasmid vector encoding a soluble NCSM-ECD-IgG1 fusion protein or fragment thereof can be made by substituting a NCSM-ECD sequence or fragment thereof for the hB7-1 ECD sequence in the vector shown in FIG. 17. Plasmid vectors encoding a hB7-1-trunECD-Ig or NCSM trunECD-Ig fusion protein are also be made using the same procedure.

In another aspect, a non-dimerizing Ig-Fc domain (PKSCDKTHTCPPCP→PKSSDKTHTSPPSP) was engineered by PCR mutagenesis (Stratagene, La Jolla, Calif.) to mutate the cysteine residues within the Ab hinge region to serine residues so as to prevent the formation of NCSM-ECD-Ig or hB7-1-ECD-Ig homodimers covalently linked by disulfide bonds between the hinge-CH2 cysteines of neighboring NCSM-ECD-Ig or hB7-1-ECD-Ig molecules. This non-dimerizing Ig-Fc domain can alternatively be used as the Ig portion in an NCSM-ECD-Ig or hB7-1-ECD-Ig fusion protein prepared as described above. Affinity purified huB7-1-ECD-IgδCys, comprising hB7-1-ECD fused to Ig in which the cysteines were mutated (represented by delta or δCys) was shown to have a molecular weight of ~70 kDa (molecular size of non-disulfide linked Fc fusion monomer) (FIG. 16). The present invention provides similarly prepared Cys-mutant Ig fusion proteins, NCSM-ECD-IgδCys or NCSM-trunECD-IgδCys, and nucleic acid sequences encoding such proteins.

D. Expression and Purification of Soluble NCSM ECD-Ig Protein

Soluble protein from CTLA-4BP-ECD-Ig fusion and CD28BP-ECD-Ig fusion expression vectors was expressed by transfection into cells of a human HEK 293 cell line using Superfect Reagent (Qiagen) and purified from crude cultured supernatants using a Hi-Trap Protein-A affinity column (Amersham-Pharmacia, Piscataway, N.J.) followed by buffer exchange into PBS, according to the manufacturer's instructions. Purity of the recovered fusion protein was assessed by SDS-PAGE followed by either silver stain or immunoblotting with a goat anti-human IgG Fc specific horseradish peroxidase (HRP) mAb (Kirkegaard and Perry Laboratories), according to manufacturer's instructions and known methods as described in, e.g., Rapley and Walker, Sambrook, and Colligan, all supra.

Figure 18:
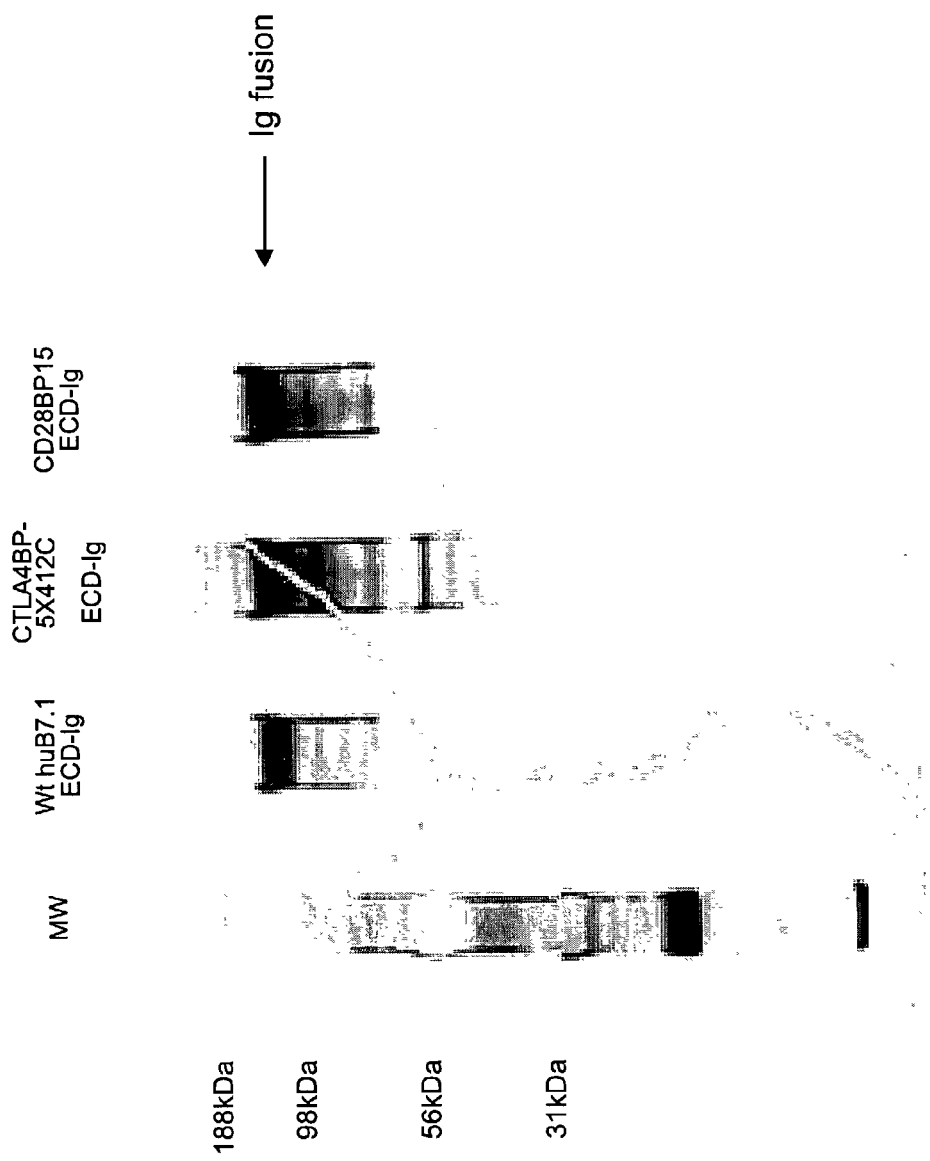
FIG. 18 is a photographic representation of an SDS-PAGE gel analysis of affinity purified CD28BP-15 ECD-Ig, CTLA-4BP 5X4-12C ECD-Ig, and WT human B7-1 ECD-Ig fusion proteins. Molecular weight standards are shown on the left.

As an example, a soluble wild-type human B7-1-ECD-Ig fusion protein (e.g., comprising, in part, an ECD fragment, "truncated ECD," or full-length ECD of hB7-1) was purified from human HEK 293 cells transfected with the expression plasmid, phuB7-1 ECD-Ig, using Protein-A affinity chromatography and fractionated on a SDS-PAGE. Serial dilutions of soluble human B7-1 ECD-Ig fusion protein showed a band which co-migrated with a commercially available form of soluble WT human B7-1-ECD-Ig or B7-2-ECD-Ig fusion protein from R&D Systems, thus demonstrating that a protein of the correct molecular weight for a soluble WT hB7-1-ECD-Ig fusion protein was produced in vitro (data not shown). The results indicated that WT hB7-1 ECD-Ig fusion protein is predominantly an ECD-Ig homodimer fusion protein. (Soluble hWT hB7-1 ECD monomer was shown to have a molecular weight on SDS-PAGE of about ~50 kDa.) SDS-PAGE analysis revealed the affinity purified CD28BP-15 ECD-Ig and CTLA-4BP 5x4-12C ECD-Ig fusion proteins co-migrated with WT human B7-1 ECD-Ig fusion proteins, as shown in FIG. 18, and thus have molecular weights nearly identical to or at least approaching that of WT hB7-1 ECD-Ig fusion protein. A reference mixture included at the far-left shows bands of compounds of known MWs (FIG. 18).

Figure 19:
FIG. 19 is a photograph of a Western blot analysis.

Crude supernatants from HEK 293 cells transfected with expression plasmids encoding either a soluble (e.g., truncated or full-length ECD) fusion protein form of various CTLA-4BPs and CD28BPs of the invention, a WT hB7-1-ECD-Ig, or a pCDNA3.1(+) vector control were fractionated on an SDS-PAGE, blotted to nitrocellulose and hybridized with a goat anti-human IgG Fc specific HRP mAb using known Western blotting methods (e.g., Rapley and Walker; Sambrook; Harlow and Lane, all supra). Results, shown in FIG. 19, showed a predominant band and fainter band around ~140 kD and ~70 kDa, respectively, which correspond to the predicted molecular weight of dimeric and monomeric forms of the NCSM fusion proteins. 8 potential N-glycosylation sites located in the ECD. Note that the MWs are approximate weights, since the proteins may be glycosylated. A band co-migrating with soluble WT hB7-1ECD-Ig was visible for all CTLA-4BP ECD-Ig and CD28BP ECD-Ig fusions. NCSM-trunECD-Igs also showed similar results to hB7-1-trunECD-Igs. The supernatant from the negative control transfection (HEK 293 cells transfected with a pCDNA3.1(+) vector) did not produce a detectable band. Oligomeric or multimeric forms (NCSM-ECD-Ig dimers, trimers, etc.) were observed for CTLA-4BPs (Clones 5X4-11D, 5X4-12C, 5X5-2E, 5X8-1F) and CD28BPs (Clones 8 and 11).

E. Construction of Stable Cell Lines Expressing Soluble NCSM-ECD and NCSM-ECD-Ig Stable 293 cell lines expressing soluble NCSM-ECD (NCSM-sECD) polypeptides or soluble NCSM-ECD-Ig fusion proteins were produced by electroporating HEK 293 cells with DraIII digested expression plasmids comprising nucleic acid sequences encoding such polypeptides or proteins according to the known methods as described in, e.g., Ausubel and Sambrook, both supra. Stable integrants were selected using DMEM containing 10% FCS and 2 mg/ml G418 antibiotic (Geneticin, Gibco-BRL). Purification was performed as described above except the eluate containing NCSM-Ig fusions from the Protein-A column was further purified by standard gel-filtration chromatography (size-exclusion chromatography) (see, e.g., Rapley and Walker; Sambrook, both supra) using a Superdex 200 10/30 (24 ml) column (Amersham-Pharmacia) (following manufacturer's instructions) to remove non-NCSM proteins. The approximate apparent molecular weights (App MW) of purified soluble NCSMs as determined by this gel-filtration analysis are shown in Table 7 below.

TABLE 7

| Molecule Type | App MW (kDa) |
|---|---|
| sCD28BP-15-ECD | ~49.04 |
| HuB7-1/Fc (commercial) | ~643.39 |
| wtHuB7-1-Ig | ~320.02 |
| wtHuB7-1-IgδCys | ~403.31 |
| CTLA-4BP 5X4-12C-Ig | ~330.28 |
| CD28BP-15-Ig | ~345.54 |

In addition to monomers of NCSM-ECD-Ig and NCSM-trun-ECD-Ig, the present invention includes aggregates and multimers of the soluble NCSM polypeptides of the invention, such as, e.g., NCSM-ECD-Ig and NCSM-trun-ECD-Ig, where the Ig portion comprises an Fc region or variant thereof as described above.

F. In Vitro Characterization of Biological Activities.

1. T Cell Proliferation Assays Using Soluble NCSM Fusion Proteins

Soluble NCSM were generated and purified as described above. Human wild-type B7-1 was also expressed using the same methods. In addition, a commercial human wild-type B7-1-Ig fusion protein was obtained from R&D Systems (see also Table 7). To characterize the biological properties of these molecules, two different formats were used to further analyze the effect of crosslinking on the function of the molecules. More specifically, we analyzed the fusion proteins both as standard soluble molecules as well after preincubation with mAbs specific for the Fc portion of human IgG (crosslinking). Crosslinking has previously been show to affect the function of wild-type human B7-1 (Rennert et al., *Intl Immunol.* 1997 June;9(6):805–13).

Either peripheral blood mononuclear cells (PBMC) or purified human T cells were used in these studies. PBMCs were isolated from human blood by centrifugation over Histopaque-1077. Peripheral blood T cells were purified from PBMC using a Moflow flow cytometer. PBMCs were used at $1 \times 10^5$ cells/well in 96-well round bottom plate (Costar). 1 ug/ml of PHA (Phytohemagglutinin) (Sigma, St. Louis Mo.) was added into the cultures. T lymphocytes were sorted by the methods described previously in "T Cell Proliferation Assay" in the "Materials and Methods" section above and used at $1 \times 10^5$ cells/well in 96-well format. T cells were cultured in the presence of soluble anti-CD3 (Pharmigen, San Diego, Calif.) to deliver a primary signal. Purified Ig fusion proteins, e.g., WT hB7-1-ECD-Ig, CD28BP-ECD-Ig, or CTLA-4BP-ECD-Ig, were added at various concentrations, and anti-CD28 mAbs (Pharmigen) were used as a positive control. To obtain crosslinked Ig-fusion molecules, purified Ig fusion proteins were pre-incubated with 5-fold excess of affinity-purified goat anti-human IgG Fc portion (KPL, Gaithersburg, Md.) for 30 minutes (min) on ice prior to use. The cross-linked complex was then added into 96-well plate containing T cells in total volume of 200 ul of Yssel's medium supplemented with 10% FBS. Assay plates were incubated for total of 3 days. The cultures were pulsed with 1 microCi/well of $^3$H-thymidine (Amersham, Piscataway, N.J.) during the last 8 hours of incubation and then harvested. $^3$H-thymidine incorporation (cpm) was calculated from triplicate cultures.

Figure 20A:
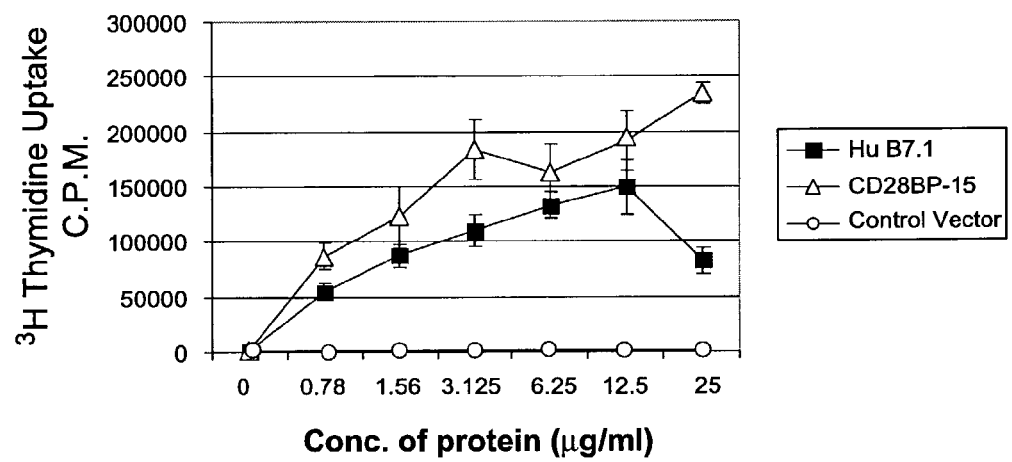
FIGS. 20A–D are graphs depicting T cell proliferation responses generated by co-culturing various crosslinked and non-crosslinked soluble NCSM fusion proteins and hB7-1 fusion proteins with purified T cells in the presence of soluble anti-CD3.

A representative experiment using crosslinked fusion proteins and purified human T cells is shown in FIG. 20A. Increasing concentrations (conc) of soluble Ig-fusion proteins of hB7.1 (solid square), CD28BP-15 (open triangle) and a control antibody human IgG Fc (open circle) were added to the cultures as indicated. A fixed concentration (125 ug/ml) of goat anti-human IgG Fc was preincubated with soluble Ig-fusion proteins prior to use. The data represent a mean+/− STD of C.P.M. The crosslinked CD28BP-15-ECD-Ig-fusion protein and WT hB7-1-ECD-Ig fusion protein induced a strong proliferative effect on purified human T cells cultured in the presence of anti-CD3 mAbs.

Figure 20B:
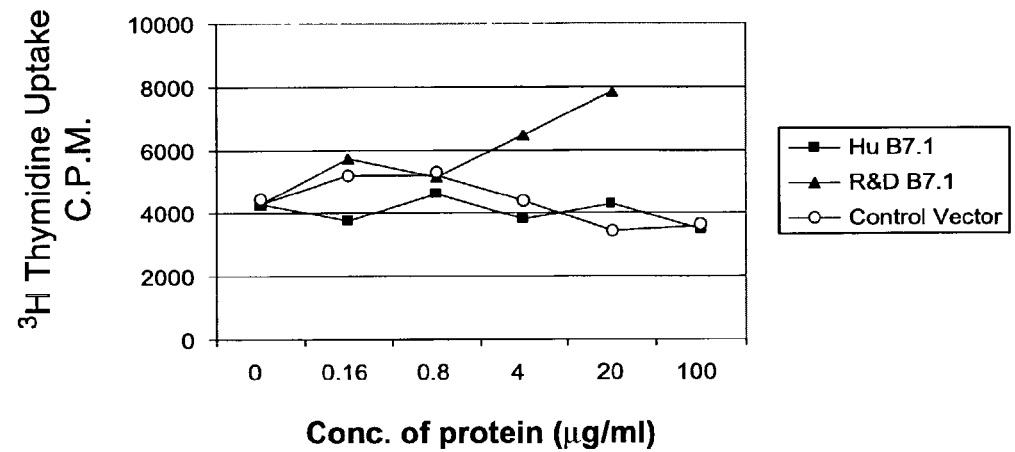

When the soluble molecules of CD28BP-15 or CTLA-4BP 5x4-12c were cultured as standard soluble molecules without prior crosslinking, no T cell activation was observed except in the case of insect cell derived commercial wildtype B7-1-Ig (see Table 7). An increasing concentration of ECD-Ig fusion proteins of hB7.1 (solid square), and a control antibody human IgG (open circle), and commercially obtained insect cell derived human B7-1-Ig fusion proteins (R&D Systems) (solid triangle), were added to cultures of PBMC and proliferation was measured as described above (FIG. 20B). The insect cell derived human B7-1-Ig fusion proteins induced proliferation of human PBMC, whereas the hB7-1 expressed in 293 cells did not induce T cell proliferation. When these proteins were analyzed by gel filtration, it was evident that the protein expressed in insect cell had a 2-fold higher molecular weight than hB7-1-Ig fusion expressed in 293 cells (Table 7). These data further support the conclusion that higher molecular weight aggregates improve the capacity of these soluble NCSM polypeptides signal through their respective ligands.

Figure 20C:
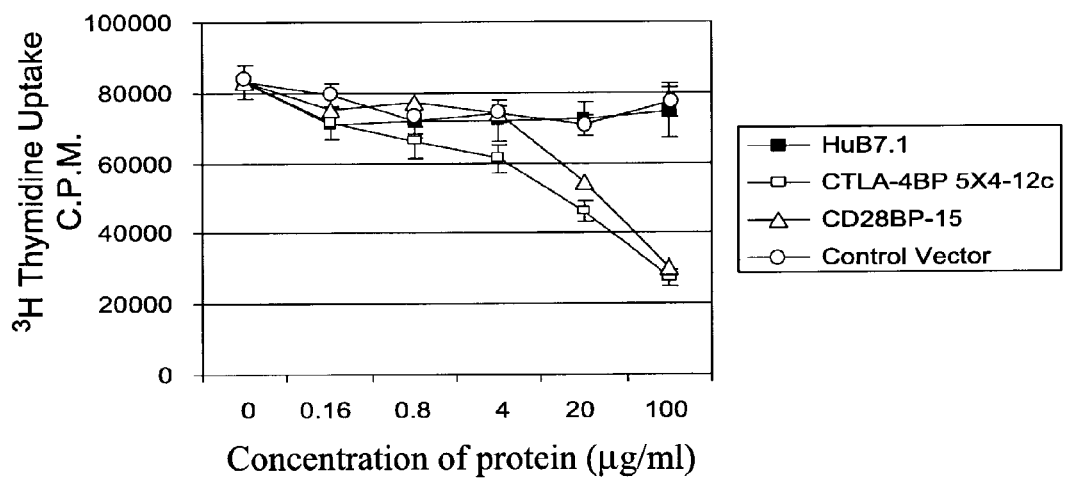

When the soluble CD28BP-15-ECD-Ig or CTLA-4BP-5x4-12C-ECD-Ig fusion proteins were cultured as soluble molecules without prior crosslinking, they inhibited PHA-induced proliferation of human PBMC in a dose-dependent manner (FIG. 20C). Wild-type hB7-1 did not affect PHA-induced proliferation of human PBMC under the same culture conditions (FIG. 20C). An increasing concentration of ECD-Ig fusion proteins of hB7.1 (solid square), CD28BP-15 (open triangle), CTLA-4BP-5x4-12C (open square) and a control antibody human IgG (open circle), made as described previously, were added as indicated in FIG. 20C. The data represent mean +/- SEM of a representative of 4 experiments, each preformed using triplicate wells.

Figure 20D:
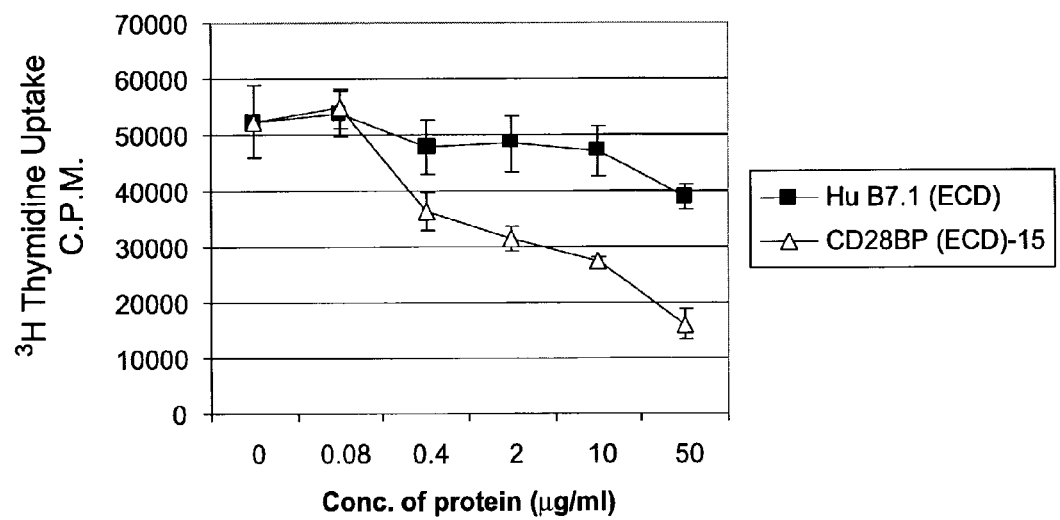

Furthermore, we studied the effect of soluble CD28BP-15-ECD (without Ig-fusion) on PHA-activated PBMC. As shown in FIG. 20D, soluble CD28BP-ECD inhibited proliferation in a dose-dependent manner and the inhibition was greater than that induced by soluble hB7-1-ECD. These data are in line with the conclusion that soluble CD28BP-15-ECD, in contrast to crosslinked soluble CD28BP-15-ECD-Ig, acts as an antagonist of CD28 signaling. In other words, the level of crosslinking and multimerization determines whether soluble NCSM induce a positive signal through their receptors CD28 and CTLA-4, or whether they act as antagonists by binding to the receptors without significantly inducing activation of the receptor (and thereby preventing the interaction of the endogenous ligands with these receptors).

These data indicate that the formulation/multimerization of the soluble NCSM fusion proteins significantly affects their biological properties. When tested as soluble molecules without crosslinking, soluble CD28BP-15-ECD-Ig and CTLA-4BP-5x4-12C-ECD-Ig fusion proteins inhibited PHA-induced proliferation of human PBMC. However, similar to the membrane-bound version of CD28BP-15, the crosslinked soluble molecule strongly enhanced the proliferation of purified T cells in the presence of soluble anti-CD3. These data indicate that crosslinked or aggregated forms of soluble forms of NCSM polypeptides (e.g., soluble NCSM-ECD-Ig, NCSM-trunECD-Ig, NCSM-ECD, NCSM-trunECD and other protein and fusion protein variants thereof) are promising drugs to activate the immune system, which is expected to be beneficial in the treatment of malignant diseases (e.g., cancer), infectious diseases, and immunoficiencies. The crosslinking can be generated in vitro (e.g., as described in assays above) or in vivo (e.g., through high-affinity binding to Fc receptors on antigen-presenting cells). In addition, when using cell-based vaccines, the crosslinking can be caused by transfecting receptors for human IgG (Fc receptors) into the cells that are used as vaccines (and the NCSM-Ig fusion binds to the Fc receptors expressed on the cells that are used as vaccines. In contrast, without prior crosslinking, the soluble NCSM polypeptides inhibited the PHA-induced proliferation of human PBMC, indicating that they have inhibitory effects on human T cell function. Furthermore, soluble CD28BP-ECD (without Ig portion) strongly inhibited T cell proliferation in vitro. Therefore, these soluble NCSM polypeptides are promising drugs for the treatment of autoimmune and inflammatory diseases, such as rheumatoid arthritis, multiple sclerosis, inflammatory bowel disease, psoriasis, and organ transplantation.

G. Variations of Soluble NCSM-ECD-IG Fusion Proteins and Related Nucleic Acid Sequences Any of the NCSM polypeptide homologues of the invention are optionally utilized in the construction of Ig fusion proteins and nucleic acids encoding them. Full-length NSCM polypeptides of the invention can be used. Furthermore, various fragments of each NCSM polypeptide can be utilized in the construction of fusion proteins, including, e.g., the entire ECD of a NCSM polypeptide (such as CD28BP-15 or CTLA-4 5x4-12c); various lengths or subsequences (e.g., truncated regions or fragments) of the ECD of a NCSM polypeptide; the cytoplasmic region of a NCSM polypeptide (and truncated regions and subsequences or fragments thereof); the transmembrane domain region of a NCSM (and truncated regions and subsequences or fragments thereof), etc.

Various additional sequences can also be added to the NCSM-Ig fusion proteins, e.g., various linker sequences (such as, e.g., Val-Thr), various proteolytic cleavage sites (such as, e.g., Factor Xa cleavage sites (IEGR), subtilisin, etc.), various Ig domains (or portions thereof), markers, purification sequences, restriction enzyme cleavage sites, and the like. As noted throughout, non-Ig sequences can also be fused to the given NCSM sequences to produce fusion proteins.

For example, as illustrated above, NCSM polypeptide sequences of the invention were utilized to construct Ig fusion proteins incorporating both linkers (V-T and G-V-T) and Factor Xa Cleavage sites. See, e.g., FIGS. 14A–14B, Tables 5–6. The NCSM portions of these fusion proteins were longer than the truncated NCSM sequences used to construct the fusion proteins as described elsewhere herein. Various sequence lengths of NCSMs (both amino acid and nucleotide) can be utilized in constructing Ig fusions as well as myriad, e.g., linkers and other sequences, etc. Various configurations of linkers, NCSM lengths, etc. are all aspects of the present invention. Any of the NCSM sequences described herein can be fused using essentially the same strategy.

The invention also provides nucleic acids encoding any of the variant soluble NSMC polypeptides and fusion proteins described above or fragments thereof. Also included are vectors and expression cassettes including such nucleic acids.

Example V

Construction of an Expression Cassette
 A. Construction of Vector pMaxVax10.1.

This example describes the construction of a vector for expression in mammalian cells. The mammalian expression vector pMaxVax10.1 (see FIG. 21) comprises, among other things: (1) a promoter for driving the expression of a transgene in mammalian cells;(2) a polylinker for cloning of one or more transgenes; (3) a polyadenylation signal (polyA); and (4) a prokaryotic replication origin and antibiotic resistant gene for amplification in *E. coli.*

1. Construction of Minimal Plasmid for Amplification in *E. coli.*

The minimal plasmid Col/Kana comprises the replication origin ColE1 and the kanamycin resistant gene (Kana$^r$). The ColE1 replication origin mediates high copy number plasmid amplification. Alternatively, low copy number replication origins, such as p15A (from plasmid pACYC177, New England Biolabs Inc.) can be used.

The ColE1 origin was isolated by polymerase chain reaction (PCR) methods known in the art from vector pUC19 (New England Biolabs Inc.). To link the ColE1 origin to the Kana$^r$ gene, NgoMIV (or "NgoMI") and DraIII recognition sequences where added to the 5' and 3' PCR primers, respectively. NgoMIV and DraIII are unique cloning sites in the vector. For subsequent cloning of the mammalian transcription unit the 5'forward primer contains the additional restriction site NheI downstream of the NgoMIV site and the 3'reverse primer additional EcoRV and BsrGI cloning sites upstream of the DraIII site. All primers contain additional 6–8 base pairs overhang for optimal restriction digest. The sequence for the 5' forward primer is: acacatagcgccggcgctagctgagcaaaaggccagcaaaaggcca. The sequence for the 3' reverse primer is: aactctgtgagacaacagtcataaatgtacagatatcagaccaagtttactcatatatac. The PCR reactions are usually performed with proof-reading polymerases, such as Tth (PE Applied Biosystems), Pfu, PfuTurbo and Herculase (Stratagene), or Pwo (Roche), according to the manufacturer's recommendations. A typical PCR reaction for Herculase polymerase contains 1 µl template plasmid DNA (1–10 ng/µl), 5 µl 10× buffer, 1 µl dNTPs (deoxynucleotide triphosphate) at 10 mM each, 1 µl forward primer (20 µM), 1 µl reverse primer (20 µM), 40 µl deionized, sterile water and 0.5 µl Herculase polymerase in a 50 µl reaction. The PCR reaction is performed at 94° C. for 30 seconds, 55° C. for 30 seconds, and 72° C. for 30 seconds per cycle, for a total of 25 cycles. The PCR products were purified with phenol/chloroform using Phase lock Gel™Tube (Eppendorf) followed by standard ethanol precipitation. The purified PCR products were digested with the restriction enzymes NgoMIV and DraIII according to the manufacturer's recommendations (New England Biolabs, Inc.) and gel purified using the QiaExII gel extraction kit (Qiagen) according to the manufacturer's instructions.

The Kanamycin resistant gene (transposon Tn903) was isolated by PCR from plasmid pACYC177 (New England Biolabs, Inc.) using standard known procedures. The Kana$^r$ gene is used for in vivo or in vitro studies. Alternative antibiotic resistant genes, such as ampicillin, tetracycline, and blasticidin resistant genes, can be used for in vivo or in vitro studies in a variety of cell cultures.

The 5' PCR primers contain the DraIII cloning site and an additional single restriction site, AscI, downstream of it. The 3' PCR primers contain the NgoMIV cloning site. The 5'forward primer sequence is: ggcttctcacagagtggcgcgcgtgtctcaaaatctct. The sequence for the 3' reverse primer is: ttgctcagctagcgccggcgccgtcccgtcaagtcagcgt. The PCR reactions, product purification and digest with DraIII and NgoMIV were performed as described above. About 20 ng of each of the two PCR products were ligated in a 20 µl reaction, containing 2 µl 10× buffer and 1U ligase (Roche). Amplification in *E. coli* was performed using standard procedures as described in Sambrook, supra. Plasmids were purified with the QiaPrep-spin Miniprep kit (Qiagen) following the manufacturer's instructions and digested with BsrG1 and DraIII for subsequent ligation of the mammalian transcription unit (promoter and polyA).

2. Expression Vector pMaxVax10.1.

In this example, the CMV Towne promoter was used for driving the expression of the transgene in mammalian cells. Alternatively, other CMV promoters or non-naturally occurring recombinant or chimeric CMV promoters can be used; for example, a chimeric or recombinant promoter, including an optimized CMV promoter, as described in copending, commonly assigned U.S. Ser. No. 09/886,942, entitled "Novel Chimeric Promoters," filed Jun. 21, 2001 as LJAQ, can be used. Different strains of CMV can be obtained from ATCC. Strains AD169 (VR-538; Rowe, W. (1956) *Proc. Soc. Exp. Biol. Med.* 145:794–801) and Towne (VR-977; Plotkin, S. A. (1975) *Infect. Immun.* 12:521–27) were isolated from human patients with CMV infections, while strains 68-1 (Asher, D. M. (1969) *Bacteriol. Proc.* 269:91) and CSG (Black, H. (1963) *Proc. Soc. Exp. Biol. Med.* 112:601) were isolated from Rhesus and Vervet monkeys, respectively. Other viral promoters, e.g., from RSV and SV40 virus, and cellular promoters, such as the actin and SRα promoter, and the like, and other promoters known to those of skill in the art, confer ubiquitous transcription in mammalian cells as well. For cell type-specific transcription, the use of cell type-specific promoters, such as muscle specific, liver specific, keratinocyte specific, and the like, and others known to those of skill in the art can be used.

The CMV Towne promoter was isolated from DNA of the CMV virus Towne strain by commonly known PCR methods. The cloning sites EcoRI and BamHI were incorporated into the PCR forward and reverse primers. The EcoRI and BamHI digested PCR fragment was cloned into pUC19 for amplification. For construction of the vector pMaxVax10.1, the CMV promoter was isolated from the pUC19 plasmid by restriction digest with BamHI and BsrG1. The BsrG1 site is located 168 bp downstream of the 5' end of the CMV promoter start, resulting in a 1596 bp fragment, which was isolated by gel purified for subsequent ligation.

The polyadenylation signal from the bovine growth hormone (BGH) gene was used in this example. Other poly A signals, which work well in mammalian cells, include, e.g., poly A signal sequences from, e.g., SV40, Herpes simplex Tk, and rabbit beta globin, and the like, and others known to those of skill in the art. The BGH poly A was isolated from the pCDNA3.1 vector (Invitrogen) using commonly known PCR methods. The 5' PCR forward primer contained additional 14 bp sequence comprising recognition sites for the restriction enzymes PmeI and BglII, which form part of the poly linker. The 3' reverse primer contains the restriction site DraIII for cloning to the minimal plasmid Col/Kana. The 5'forward primer sequence is: agatctgtttaaaccgctgatcagcctcgactgtgccttc. The 3'reverse primer sequence is: acctctaaccactctgtgagaagccatagagcccaccgca. The resulting PCR product was diluted 1:100, and 1 µl was used as a template for a second PCR reaction with the same 3'reverse primer and a new 5' forward primer. This primer was overlapping the 5' end of the template by 20 bp and contained another 40 bp 5', containing BamHI, KpnI, XbaI, EcoRI and NotI recognition sequences to form the rest of the polylinker. The sequence of the 5'extension primer is: ggatccggtacctctagagaattcggcggccgcagatctgtttaaaccgctga. An alternative PCR product was generated with different 5'forward PCR primers to generate a vector with a modified polylinker, designated pMaxVax10.1 mp (FIG. 21 with modified polylinker as described above). The orientation of the restriction sites in this polylinker is 5'-3': BamHI, XbaI, KpnI, EcoRI, NotI, BglII, and PmeI. The polylinker sequence is: ggatccactcatctagaacaatggtaccaatacgaattcggcggccgcagatctgtttaaacc. The PCR products were digested with BamHI and DraIII and gel purified.

The final ligation reaction contained about 20 ng each of the BsrG1 and BamHI digested CMV promoter, of the BamHI and DraIII digested polylinker and BGH poly A, and the DraIII and BsrG1 digested minimal plasmid Col/Kana in a 50 µl reaction with 5 µl 10× ligase buffer and 2U ligase (Roche). Ligation, amplification and plasmid purification were performed as described above.

B. Construction of Vector pMaxVax with NCSM Polynucleotide Sequence

The nucleotide sequence encoding a NCSM polypeptide (e.g., a CD28BP or CTLA-4BP polypeptide or fragment thereof, such as an ECD domain) or any other immunomodulatory molecule can be isolated by PCR with BamHI and KpnI restriction enzyme recognition sequences in the PCR forward and reverse primer as described above. In this example, a polynucleotide sequence encoding a CD28BP polypeptide (e.g., CD28BP-15 polypeptide (SEQ ID NO:19) is incorporated into the pMAxVax 10.1 vector. To verify the correct sequence of the PCR products, the fragments are cloned conveniently into the TOPO® cloning vectors (Invitrogen) for sequencing according to the manufacturer's protocols. After BamHI and KpnI digestion and gel purification, the genes are cloned into a mammalian expression vector to confirm the expression of the gene. To clone the genes into the polylinker of pMaxVax, the vector pMaxVax 10.1 mp (FIG. 21 with modified polylinker as described above) was digested with BamHI and KpnI, gel purified and ligated to the respective genes, as described above. The construct pMaxVax-CD28BP (see FIG. 22A), which includes the nucleotide sequence encoding a CD28BP (here, e.g., SEQ ID NO:19), can be used for in vivo and in vitro expression in human and other mammalian cells and other cells in culture, including non-mammalian cells and the like.

For in vitro expression the immune stimulatory molecules can also be cloned in any commercially available vectors such, as pCDNA3.1+/−, pCDNA4 (Invitrogen), which are suitable for stable expression under drug selection in mammalian cells. If secretion is a desired feature, the genes can be cloned into vectors such as pSecTag, pDisplay, pBC1 (Invitrogen), which link the expressed proteins to secretion signals. For regulated expression vectors from the Tet™System (Clontech) or Ecdysone regulatory vectors (Invitrogen) can be used. For high expression levels in cell culture the immune stimulatory molecules can also be cloned into viral vectors constructed from Retrovirus, Adenovirus (Clontec), and Sindbis virus (Invitrogen), or replicating viral vectors constructed from EBV, BPV, HPV and SV40 virus. For in vivo studies, viral vectors constructed from Adenovirus, Lentivirus, and Alphaviruses, and the like can be used. If restriction sites other than BamHI and KpnI are required for cloning into the different vectors, flanking restriction sites from the polylinker can be used. Alternatively, the genes can be isolated by PCR with the desired restriction sites located in the PCR primers as described above.

C. Bicistronic vector pMaxVax-CD28BP-Ep-CAM/KSA.

For immunotherapy studies it is desirable to express the immunostimulatory molecule in the same cells as, for example, a cancer antigen. A nucleotide sequence encoding a cancer antigen, such as EpCam/KSA, can be cloned into the pMaxVax vector (FIG. 21) to generate a pMaxVax-EpCam/KSA vector, using a procedure analogous to that described above for cloning the CD28BP polynucleotide sequence into the pMaxVax vector backbone. Two expression constructs, e.g., the pMaxVax-CD28BP vector (FIG. 22A) (or other pMaxVax-NCSM vector) and the pMaxVax-EpCam/KSA vector (or other pMaxVax vector including a nucleotide sequence encoding an antigen), can then be co-transfected in cell culture or co-administered in vivo to a subject in need of such therapeutic or prophylactic treatment.

In an alternative format, which may be an optimal format for some therapeutic or prophylactic applications, both the EpCam/KSA and CD28BP genes (or a different antigen gene and/or NCSM polynucleotide) can be expressed from the same vector. In one format, the resulting antigen and NCSM proteins can be co-expressed from a single promoter linked by an internal ribosomal entry site (e.g., IRES bicistronic expression vectors, Clontec). This example describes the construction of an exemplary bicistronic vector for expression of at least one NCSM polypeptide and at least one antigen or antigen fragment (or a different co-stimulatory molecule) in which the NCSM polynucleotide and the nucleotide sequence encoding the antigen or antigen fragment form two separate expression units. In particular, this example describes the construction of a bicistronic vector for expression of CD28BP (e.g., CD28BP-15) and the cancer antigen Ep-CAM/KSA in which the CD28BP polynucleotide and the polynucleotide encoding the cancer antigen or antigen fragment form two separate expression units, each regulated by its own respective promoter and poly A signal. One of skill will understand that this procedure can also be readily adapted to construct a bicistronic vector comprising at least one NCSM polynucleotide of the invention (including nucleic acid fragments thereof, and nucleic acids encoding soluble NCSM polypeptides, peptide fragments thereof, and fusion proteins thereof described herein) and a different antigen or antigen fragment (or a different co-stimulatory molecule).

The CD28BP gene is inserted into the polylinker of a pMaxVax vector as described above, forming the first expression unit. The nucleic acid sequence of the cancer antigen, here the polynucleotide encoding the extracellular domain of Ep-CAM/KSA, is linked to a second mammalian expression promoter (exemplary promoters include those set forth in this Example above and elsewhere) and a second poly A signal (exemplary signals include those set forth in this Example above and elsewhere) to form the second expression unit. The second expression unit can be cloned into 3 different sites in the construct pMaxVax-CD28BP, both in forward or reverse orientation: (i) downstream of the first expression unit (CMVpromoter-CD28BP-BGHpolyA) using the single cloning sites DraIII and AscI in pMaxVax10.1; (ii) between the ColE1 and Kana$^r$ gene using the single restriction sites NgoMI and NheI; (iii) between the Kana$^r$ gene and the CMV promoter into the single EcoRV and BsrGI restriction sites (see vector description above in this Example). Independent of the location of the second expression unit it is advisable to add a terminator sequence downstream of the first expression unit. A consensus terminator sequence 5'-ATCAAAA/TTAGGAAGA3' is described in Ming-Chei Maa et al. (1990) *JBC* 256 (21):12513–12519. In the construct pMaxVax,CD28BP the sequence can be placed into the single DraIII site downstream of the BGH poly A (see FIG. 22B).

This example describes the cloning strategy of the second expression unit for location (ii). The second promoter (e.g., a WT CMV promoter, such as human CMV promoter or a recombinant CMV promoter with improved expression activity), the Ep-CAM/KSA cancer antigen, and the second poly A (in the example SV40 polyA), are isolated from the respective template plasmids by PCR (as described above in this Example). The PCR primers are designed to contain single restriction sites, which allow for partial site-directed cloning of the three fragments into the final vector. The 5'forward PCR primer for isolation of the shuffled CMV promoter contains the single NgoMIV (also called NgoMI) cloning site. The 3'reverse primer contains the NgoMIV site and another restriction enzyme site, which does not cut in any of the other vector units (i.e. AccI, AgeI, AvrII, BsU36I, MluI, RsrII, SalI) upstream of it separated by a spacer of at least 10 base pairs. In the example AccI is chosen as the additional cloning site. The PCR product is digested with NgoMIV followed by gel purification and cloned into the NgoMIV linearized and gel purified pMaxVax,CD28BP. The correct orientation of the second CMV promoter after ligation is determined by PCR from bacterial colonies (as described in Molecular Cloning, A Laboratory Manual, Sambrook and Russell) using the 3'reverse primer and any forward primer of choice located about 500–600 bp upstream of the reverse primer in the CMV promoter sequence. The second promoter containing plasmid is then digested with AccI and NheI for cloning of the cancer antigen. The 5'primer for the Ep-CAM/KSA cancer antigen contains the single AccI site and the 3'primer the single NheI site and an additional single restriction site upstream, AgeI, separated by a spacer of at least 10 base pairs. The PCR product is digested with the enzymes AccI and NheI and cloned into the equally digested vector. The resulting construct is digested AgeI and NheI for cloning of the SV40 polyA/terminator fragment. The 5' forward primer for this PCR product contains the single AgeI site and the 3'reverse primer the terminator sequence followed by the single NheI site. The resulting AgeI/NheI fragment is then cloned in the equally digested vector. The cloning strategy is outlined below.

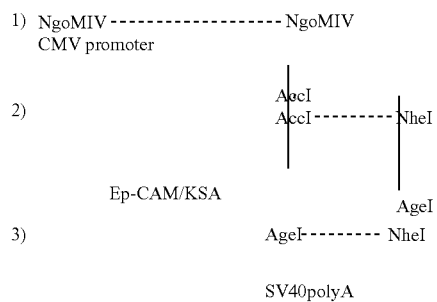

Figure 22B:
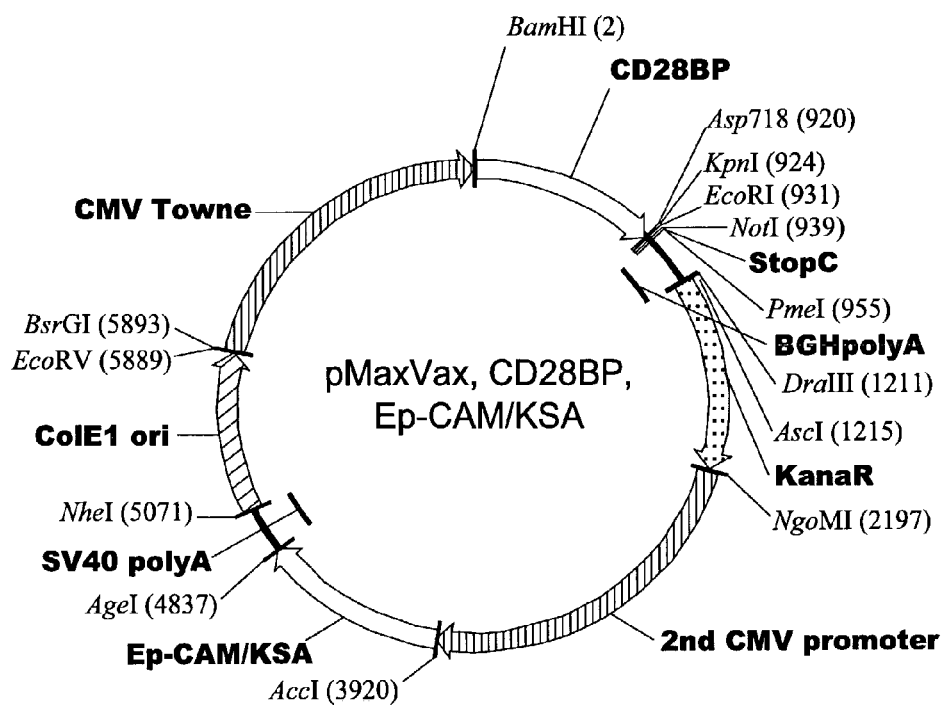
FIG. 22B illustrates a bicistronic pMaxVax10.1 plasmid expression vector that comprises a nucleotide sequence encoding a CD28BP polypeptide and a nucleotide sequence encoding the cancer antigen EpCam/KSA. Positions of various components of the vectors, including the promoter(s), kanamycin resistant gene, ColE1 replication of origin, BGH poly A adenylation sequences and restriction sites are shown.

The final construct pMaxVax,CD28BP,Ep-CAM/KSA is shown in FIG. 22B.

One of skill will understand that a similar procedure can be used to construct an expression vector comprising a nucleotide sequence encoding a CTLA-4BP of the invention (in place of the sequence encoding CD28BP above in FIG. 22A. Such a vector can comprise a bicistronic vector, if desired, with a second nucleotide sequence of interest (e.g., encoding an antigen or another co-stimulatory molecule) included in the position occupied above by the antigen, as shown in FIG. 22B. One of skill will also understand the above procedure can be readily adapted to construct an expression vector comprising different vector components, such as different promoters, signal sequences, termination sequences, replication origin sequences, resistant gene or marker sequences.

Example VI

Enhanced Immune Response Induced by a CD28BP Polypeptide

This example demonstrates the ability of a CD28BP molecule of the present invention (or fragment thereof) to enhance an immune response of a heterologous antigen, such as a tumor-associated antigen (Ag), such as, e.g., Ep-Cam/KSA (as described in Strand et al. (1989) *Cancer Res.* 49:314–317; Szala et al. (1990) 87:3542–3546; Balzar et al. (1999) *J Mol Med* 77:699–712), or a pathogen antigen (e.g., hepatitis B surface Ag (HepBsAg)), in cynomolgus monkeys. In this example, a vector comprising a nucleotide sequence encoding full-length clone CD28BP-15 is used. If desired, alternatively a vector comprising a nucleotide sequence encoding a fragment of CD28BP-15 (e.g., such as an ECD) or encoding a fusion protein (e.g., ECD-Ig) can be used. For example, a sequence encoding a soluble NCSM of the invention (e.g., CD28BP-15ECD, CD28BP-15-ECD-Ig, or with a trunECD, or the like) can be used. A vector comprising a nucleotide sequence encoding a WT hepatitis B surface antigen (hepBsAg) (or fragment thereof) and a vector comprising a nucleotide sequence encoding Ep-Cam (or fragment thereof) is used as the antigen sequence. The procedure can be adapted to use any NCSM molecule described herein and/or any antigen of interest, including, e.g. viral antigens or other cancer antigens described infra.

In the following example, separate vectors are prepared that encode each of EpCam, WT hB7-1, CD28BP-15, and the antigen. A separate control vector is also prepared. See Example V. However, as noted below and as described in Example V, a bicistronic vector encoding antigen (e.g., EpCam) and B7-1, or encoding antigen (e.g., EpCam) and CD28BP-15 can be used alternatively. Vectors comprising sequences encoding other antigens and/or NCSM molecules, cytokines, costimulatory sequences, and the like or other vector elements can be constructed by using the vector construction procedures described above. One of skill will readily understand how to modify/adapt these procedures to construct vectors comprising nucleotide sequences encoding such NCSM molecules with or without also encoding any of such antigens.

In this analysis, five groups of cynomolgus monkeys (3 monkeys per group) are inoculated intradermally (i.d.) (e.g., by a gene gun or injection with a needle) using DNA plasmid expression vectors with either CD28BP-15 alone, hB7.1 alone, antigen (Ag) alone, CD28BP-15 with Ag or hB7.1 with Ag, each at a total dose of 1 milligram DNA per inoculation as outlined in Table 8 below. A DNA plasmid control vector lacking a nucleic acid insert encoding a CD28BP-15, hB7-1, or Ag is used to equalize the total amount of DNA used in each injection. Procedures for constructing the pMaxVax plasmid vector alone (control vector) and a plasmid vector comprising a nucleotide sequence encoding CD28BP-15 are described in Example V above. Similar procedures can be used to construct a separate pMaxVax vector or the like comprising a nucleotide sequence encoding a human B7-1, Ag, or HepBsAg, as shown in Table 8. Alternatively, another plasmid-based mammalian expression vector or a viral vector can be employed in the following procedure, including any of those described above in the specification. Immunized animals are monitored daily for any local and systemic reactions.

TABLE 8

| Group | No. of animals | Immunization | Dose (mg DNA) for each vector |
|---|---|---|---|
| 1 | 3 | CD28BP-15 vector + Control vector | 0.5 + 0.5 |
| 2 | 3 | HB7.1 vector + Control vector | 0.5 + 0.5 |
| 3 | 3 | Ag vector + Control vector | 0.5 + 0.5 |
| 4 | 3 | CD28BP-15 vector + Ag vector | 0.5 + 0.5 |
| 5 | 3 | HB7.1 vector + Ag vector | 0.5 + 0.5 |

Animals. Five groups of 3 male Cynomolgus monkeys each weighing approximately 4 kg (15 total) are used. Animals are randomly assigned to groups using a number draw. In addition, each animal is assigned a specific number within that group. Inocula. Mixtures of plasmid DNA to contain 0.5 mg of each (separate) vector component as outlined in Table 8 are prepared. Total plasmid DNA delivered is 1 mg in each case. Each DNA expression plasmid is diluted in PBS, pH 7.4 from a stock solution to achieve the target concentration in 1 ml per inoculum.

(Alternatively, a bicistronic format is used in which the following plasmid vectors are made and substituted in the procedure:1) a plasmid vector comprising a nucleotide sequence encoding EpCam (total DNA plasmid dose is 1 mg) (antigen control vector); 2) a plasmid vector comprising a nucleotide sequence encoding both EpCam and WT hB7-1 (total DNA plasmid dose is 1 mg) (antigen/WT hB7-1 control vector) (bicistronic vector that co-expresses Ag and hB7-1); 3) a plasmid vector comprising a nucleotide sequence encoding both EpCam and CD28Bp-15 (or fragment thereof, including soluble form) (total DNA plasmid dose is 1 mg)(bicistronic vector co-expressing EpCam, and CD28BP-15). The bicistronic vectors are prepared as described for the pMaxVax bicistronic vector encoding both a CD28BP and EpCam in Example V above.

Inoculation. Animals are anaesthetized prior to inoculation. The backs of the animals are first prepared by shaving the fur and the animals are inoculated by i.d. injection with 1.0 ml of the 1 mg DNA plasmid (or alternative amounts described below) at multiple sites. The monkeys are boosted three times at 3 weekly intervals with the same inoculation dose.

Observation and monitoring. Each inoculation site is examined every day, beginning at day 1, for any delayed-type hypersensitivity (DTH) reaction. Animals are observed daily for signs of systemic reaction to the inoculation. These observations include, but are not limited to, changes in weight, body temperature, eating habits, skin and hair, eyes, mucous membranes, respiratory system, circulatory system, central nervous system, somatomotor activity, elimination, behavior, and any occurrence of tremors, convulsions, salivation, diarrhea, lethargy, or coma.

Collection of blood. Monkeys are bled to obtain 2–5 ml of whole blood one day prior to immunization and weekly thereafter. Blood is allowed to clot, serum separated, frozen at −20° C. until further analysis. On alternate weeks, however, 5–10 ml of blood is drawn in heparinized tubes for T cell assay analysis.

Tissue collection. Punch biopsies of the inoculation site are taken according to standard known procedures once every three weeks.

Sample analysis. Antibody titers against each of Ep-Cam and HepBsAg in the sera of the animals are determined, respectively, using ELISA assays (Mosolits et al. (1999) *Cancer Immunol. Immunoth* 47:315–320; Staib et al. (2001) *Intl. J. Cancer* 92:79–87; Chow et al. (1997) *J. Virol.* 71:169–178). Furthermore, T cell proliferation in response to one of these antigens is analyzed by adding 10 g/ml of the antigen to cultures of $10^5$ peripheral blood monocyte cells (PBMC). The cells are incubated for 3 days and incorporation of $^3$H-thymidine during the last 8 hours of culture is measured by scintillation counting (as described in Punnonen et al. (1994) *J. Immunol.* 152:1094–1102). See T cell proliferation methods described above. A higher T cell proliferative response indicates a more vigorous immune response as a result of the vaccination.

Cytokine production, such as, e.g., IFN-gamma, IL-2, IL-4, IL-5, and IL-13 production, is studied in response to the specific antigen using cytokine specific ELISAs (R&D Systems) or ELISpot assays (Biosource International, Camarrillo, Calif.), performed according to the manufacturer's instructions. For example, enumeration of IFN-gamma secreting cells in single cell suspension is performed using a kit obtained from Biosource International (Camarrillo, Calif.) (see manufacturer's instructions). The following protocol is used. 50 µl of diluted coating antibody is added to each well followed by the addition of 50 µl of PBS. Each well is incubated overnight at 4° C. Samples are then aspirated and washed 5 to 10 times with wash buffer. 200 µl of post-coating solution is added into each well and wells are incubated 1 hour at 37° C. or overnight at 4° C. The wells are aspirated and not washed. Wells are 100 µl of prestimulated single cell preparation are added into the wells. The plate is covered with the plate cover and incubated for 5 hours at 37° C. in a humidified atmosphere containing 7% $CO_2$. The wells are aspirated, 200 µl ice-cold deionized water is added, and the plate is placed for 10 min on melting ice. The wells are washed 10 times with PBS. 100 µl of diluted biotinylated Antibody solution is added, the plate is covered and incubated for 1 hour at 37° C. or overnight at 4° C. The wells are aspirated and washed 5 to 10 times with PBS. 50 µl of diluted—labeled anti-biotin antibody solution (GABA) is added to each well. The plate is covered and incubated 1 hour at 37° C. The wells are aspirated and washed 5 to 10 times. 30 µl of activator solution is added to each well. The spot development is followed by light microscopy. When clear spots have developed, the reactions are stopped by rinsing the wells with distilled water. The results are compared between animals immunized with the antigen with or without CD28BP-15.

Such plasmid expression vectors encoding CD28BP-15 with and without an antigen are useful in therapeutic and prophylactic treatment protocols as described above. Plasmid expression vectors encoding CD28BP-15 and EpCam/KSA are useful in methods for therapeutically and/or prophylactically treating a variety of cancers, as described above. Given that the primate model is an accepted model closely related to human, such methods may be readily adapted by one of ordinary skill in the art to therapeutic and/or prophylactic vaccination protocols for humans.

A similar procedure to that described above can be employed to assess an ability of a CTLA-4BP of the invention to inhibit an immune response or inhibit T cell proliferation or CTL responses in a subject, by substituting a nucleotide sequence encoding a CTLA-4BP of the invention in place of the nucleotide sequence encoding CD28BP-15 and using the functional assays for, e.g., T cell activation. For example, T cell activation can be analyzed by measuring proliferation, cytokine production, CTL activity or expression of activation antigens such as IL-2 receptor, CD69 or HLA-DR molecules, as described above. Vectors that harbor CTLA4-BP genes that efficiently act through CTLA-4 are useful in inducing, for example, tolerance and anergy of allergen- or autoantigen-specific T cells. In some situations, such as in tumor cells or cells inducing autoimmune reactions, the antigen may already be present on the surface of the target cell, and the vectors encoding CTLA-4BP molecules may be transfected in the absence of additional exogenous antigen gene.

Boosting. In methods described herein using either separate vectors encoding each of Ag, hB7-1 or CD28BP, or bicistronic vectors encoding Ag and CD28BP, or Ag and hB7-1, one or more additional doses of DNA plasmid vector (e.g., 1 mg) can be administered subsequently to an animal at one or more subsequent intervals (e.g., 2 times), respectively enhance or "boost" the immune response. If desired, following a boosting of the immune response with such administration of one or more additional the DNA plasmid vector doses, at least one dose of the EpCam protein (protein dose of from about 0.1 to about 1 mg) ("protein boost) can be administered to an animal to further enhance or "boost" the immune response.

Example VII

Blocking Development of EAE

The mouse model of Experimental Autoimmune Encephalomyelitis (EAE) has many similarities with human multiple sclerosis (MS), and it has been widely used as a model of human MS (see, e.g., Alvord, G. C. Jr., ed., *Experimental Allergic Encephalomyelitis: A Useful Model for Multiple Sclerosis*, Liss, N.Y. (1984)). EAE can be induced in SJL/F mice by myelin basic protein (MBP) or proteolipid-protein (PLP) or peptides thereof.

To demonstrate the efficacy of a CTLA-4BP molecule of the invention to prevent EAE, the following prophylactic treatment vaccination protocol is used. DNA expression plasmids encoding either CTLA-4BP or MBP (or PLP) are codelivered, or the two genes for CTLA-4BP and MBP (or PLP) are coexpressed in the same vector and delivered, as follows. In this example, a nucleotide sequence encoding clone CTLA-4BP 5x4-12c is used. Procedures for constructing the pMaxVax plasmid vector alone (control vector) or with a nucleotide sequence encoding a CD28BP and/or a second polypeptide (EpCam) are described in Example V above. One of skill can readily adapt such procedures to construct pMaxVax vectors comprising the nucleotide sequence encoding a CTLA-4BP and/or MLP (or PLP), expressed alone on separate vectors or coexpressed on one vector. Alternatively, another plasmid-based mammalian expression vector or a viral vector can be used in the following procedure, including any of those described above in the specification. 100 μg of the DNA plasmid in 100 μl PBS is injected intramuscularly or intradermally to SJL/F female mice. A control DNA plasmid lacking the CTLA-4BP, MBP, or PLP nucleotide sequence is similarly administered to a control group of mice.

To induce EAE, mice are injected intradermally with 100 μl rabbit brain myelin basic protein (MPB) at 1 mg/ml in complete Freund's adjuvant. Mice are analyzed for the onset of EAE by visually noting tail paralysis followed by hind leg paralysis (at which point animals are sacrificed for humane reasons).

The ability of a DNA plasmids encoding CTLA-4BP and/or MBP (or PLP) to block EAE is demonstrated by the number of mice developing EAE and the severity of the disease, as compared to mice that received the control DNA plasmid.

Example VIII

Improved Cell-Based Vaccines for the Treatment of Cancer

To enhance the immunogenicity of tumor cells used as cell-based vaccines for the immunotherapeutic or prophylactic treatment of a variety of cancers, patient tumor cells can be transfected with a CD28BP nucleic acid (NA) sequence of the present invention. In this example, the sequence corresponding to clone CD28BP-15 is used; however, other NA sequences of the invention can be readily employed. As an example, the specific immunotherapy involves immunization of melanoma patients with a polyvalent, irradiated whole cell melanoma cells transfected with a DNA plasmid encoding CD28BP-15.

In one such method, a population of tumor cells derived from a melanoma patient's melanoma tumor cell lines (i.e., cells removed from the patient) are transfected (e.g., by electroporation) with a sufficiently effective amount of DNA expression plasmid vector, pMaxVax, encoding CD28BP-15 (or fragment thereof, e.g., CD28BP-15-ECD or expressed soluble CD28BP) that facilitates uptake and expression of CD28BP-15 polypeptide on the cells; the amount of DNA plasmid typically constitutes a therapeutically or prophylactically effective amount or dosage to treat the melanoma cancer or prevent further development of the cancer. The pMaxVax plasmid is described in example V above. Or, another plasmid-based mammalian expression vector, or viral vector, can be used in this procedure, including those described herein and throughout.

These transfected tumor cells are inactivated by irradiation (50 gray) and cryopreserved for used as the cell-based vaccine. Prior to treatment (delivery to the patient), the cells to be used as vaccine are thawed and washed 3 times in phosphate-buffered saline; if desired, the cells to be used as a vaccine are formulated as a composition with an excipient, such as, e.g., a pharmaceutically acceptable excipient, e.g., PBS. (In an alternative format, allogeneic melanoma tumor cells are transfected with a sufficient amount of pMaxVax DNA plasmid vector encoding CD28BP-15 (or a fragment thereof, e.g., CD28BP-ECD) for CD28BP-15 expression.) Transfected tumor cells encoding an effective amount of expressed CD28BP-15 (or a composition comprising such cells)—either those derived from the specific patient's cell line or allogeneic cells—are injected intradermally into the specific patient in auxiliary and inguinal regions in escalating doses once every 2 weeks for 3 months. The first and second injections of the vaccine comprise $2 \times 10^6$ cells, followed by $6 \times 10^6$ cells for the third and fourth injections, and then $18 \times 10^6$ cells for the fifth and sixth injections.

Immune responses of each patient are analyzed by measuring the levels of tumor cell specific Abs and the level of T cell response against the antigen or antigenic fragment expressed on the tumor cells by analyzing T cell proliferation in response to tumor cell lysates and measuring delayed type hypersensitivity (DTH) reaction. T cell response against the cancer antigen is analyzed using standard methods described above (see, e.g., Example VI). Levels of tumor cell specific Abs in the patients' sera are measured by ELISA using standard protocols (see Colligan; Sambrook; Rapley and Walker, all supra). To analyze DTH, tumor cell lysates are injected intradermally into the back of patients. Responses are evaluated on days 1, 2, 4, and 7 after injection. The mean diameter of induration is calculated as (greatest diameter+perpendicular diameter)/2. A positive response is defined as a mean diameter of induration of 5 mm. Four-millimeter punch biopsies of positive reactions are performed on selected consenting subjects to analyze the phenotype of infiltrating cells using flow cytometry (FACSCalibur flow cytometer and CellQuest software, BDIS) as described above. The single cell suspensions are then stained anti-CD3, CD4, CD8, CD14, and CD20 monoclonal antibodies to measure the percentages of T cells, CD4+ T helper cells, CD8+ cytotoxic T cells, monocytes and B cells, respectively.

Estimated statistical survival rates are analyzed by the non-parametric Kaplan-Meier method (see Kaplan et al., *J Am Stat Assoc* (1958) 53:457) (e.g., using the statistical analysis software JMP (ver. 3.1 for Macintosh; SAS Institute Inc., Cary, N.C.)). The log-rank test is used to determine the differences in survival of patients from subgroups defined by different levels of risk factors. Survival times are defined as the length of time a given patient remains alive after the diagnosis of metastatic disease to either a regional site (AJCC Stage IIIA), with regard to skin and soft tissue metastasis, or a distant site (AJCC Stage IV).

While the foregoing invention has been described in some detail for purposes of clarity and understanding, it will be clear to one skilled in the art from a reading of this disclosure that various changes in form and detail can be made without departing from the true scope of the invention. It is understood that the examples and embodiments described herein are for illustrative purposes only and that various modifications or changes in light thereof will be suggested to persons skilled in the art and are to be included within the spirit and purview of this application and scope of the appended claims. For example, all the techniques and apparatus described above may be used in various combinations. All publications, patents, patent applications, and/or other documents cited in this application are incorporated herein by reference in their entirety for all purposes to the same extent as if each individual publication, patent, patent application, and/or other document were individually indicated to be incorporated herein by reference in its entirety for all purposes.

SEQUENCES

| SEQ ID | Clone ID Name | Sequence |
|---|---|---|
| SEQ ID NO:1 | Round 1 (R1) CD28BP-71 (Clone 71) | ATGGGTCACACAATGAAGTGGGGATCACTACCACCCAAGCGCCCATGCCTCTGGCTCTCTC<br>AGCTCTTGGTGCTCACTGGTCTTTTTTACTTCTGTTCAGGCATCACCCCAAAGAGTGTGAC<br>CAAAAGAGTGAAAGAAACAGTAATGCTATCCTGTGATTACAACACATCCACTGAAGAACTG<br>ACAAGCCTTCGGATCTATTGGCAAAAGGATAGTAAAATGGTGCTGGCCATCCTGCCTGGAA<br>AAGTGCAGGTGTGGCCTGAGTACAAGAACCGCACCATCACTGACATGAACGATAACCCCCG<br>TATTGTGATCCTGGCTCTGCGCCTGTCGGACAGTGGCACCTACACCTGTGTTATTCAGAAG<br>CCTGTTTTGAAAGGGGCTTATAAACTGGAGCACCTGGCTTCCGTGAGGTTAATGATCAGAG<br>CTGACTTCCCTGTCCCTACCATAAATGATCTTGGAAATCCATCTCCTAATATCAGAAGGCT<br>AATTTGCTCAACCTCTGGAGGTTTTCCAAGGCCCCACCTCTACTGGTTGGAAAATGGAGAA<br>GAATTAAATGCTACCAACACAACACTGTCCCAAGATCCTGAAACCAAGCTCTACATGATTA<br>GCAGTGAACTGGATTTCAACATGACAAGCAATCACAGCTTCTTGTGTCTTGTCAAGTATGG<br>AGACTTAACAGTGTCACAGACCTTCTACTGGCAAGAATCCAAACCAACCCCTTCTGCTAAT<br>CAGCACCTGACCTGGACCATTATTATCCCAGTCTCAGCATTTGGGATTTCTGTGATCATTG<br>CAGTTATACTAACATGCCTGACCTGCAGAAATGCTGCAATACGCAGACAGAGAAGGGAGAA<br>TGAAGTGGAAATGCAAAGTTGCTCTCAGTCTCCATGA |
| SEQ ID NO:2 | Round 1 CD28BP-84 (Clone 84) | ATGGGCCACACGCTGAGGCCGGGAACTCCACTGCCCAGGTGTCTACACCTCAAGCTCTGCC<br>TGCTCCTGGCGCTGGCGGGTCTCCACTTCTCTTCAGGTATCAGCCAGGTCACCAAGTCGGT<br>GAAAGAAATGGCAGCACTGTCCTGTGATTACAACATTTCTATCGATGAACTGGCGAGAATG<br>CGCATATACTGGCAGAAGGACCAACAGATGGTGCTGAGCATCATCTCTGGGCAAGTGGAAG<br>TGTGGCCTGAGTACAAGAACCGCACCTTCCCCGACATCATTAACAACCTCTCCCTTATGAT<br>CCTGGCACTGCGCCTGTCGGACAAGGGCACCTACACCTGCGTGGTTCAGAAGAATGAGAAC<br>GGGTCTTTCAGACGGGAGCACCTGACCTCCGTGACACTGTCCATCAGAGCTGACTCCCCTG<br>TCCCTAGCATAACTGACATTGGACATCCCGCCCCTAATGTGAAAAGGATAAGATGCTCCGC<br>CTCTGGAGGTTTTCCAGAGCCTCGCCTCGCCTGGATGGAAGATGGAGAAGAACTAAACGCC |

-continued

SEQUENCES

| SEQ ID | Clone ID Name | Sequence |
|---|---|---|
| | | GTCAACACGACGGTTGACCAGGATTTGGACACGGAGCTCTACAGCGTCAGCAGTGAACTGG |
| | | ATTTCAATGTGACAAATAACCACAGCATCGTGTGTCTCATCAAATACGGGGAGCTGTCGGT |
| | | GTCACAGATCTTCCCTTGGAGCAAACCCAAGCAGGAGCCTCCCATTGATCAGCTTCCATTC |
| | | TGGGTCATTATCCCAGTAAGTGGTGCTTTGGTGCTCACTGCGGTAGTTCTCTACTGCCTGG |
| | | CCTGCAGACATGTTGCGAGGTGGAAAAGAACAAGAAGGAATGAAGAGACAGTGGGAACTGA |
| | | AAGGCTGTCCCCTATCTACTTAGGCTCTGCGCAATCCTCGGGCTGA |
| SEQ ID NO:3 | Round 1 CD28BP-118 (Clone 118) | ATGGGCCACACGCTGAGGCCGGGAACTCCACTGCCCAGGTGTCTACACCTCAAGCTCTGCC |
| | | TGCTCTTGGCGCTGGCGGGTCTCCACTTCTCTTCAGGTATCAGCCAGGTCACCAAGTCGGT |
| | | GAAAGAAATGGCAGCACTGTCCTGTGATTACAACATTTCTATCGATGAACTGGCGAGAATG |
| | | CGCATATACTGGCAGAAGGACCAACAGATGGTGCTGAGCATCATCTCTGGGCAAGTGGAAG |
| | | TGTGGCCTGAGTACAAAAACCGCACCTTCCCCGACATCATTAACAACCTCTCCCTTATGAT |
| | | CCTGGCACTGCGCCTGTCGGACAAGGGCACCTACACCTGCGTGGTTCAGAAGAATGAGAAC |
| | | GGGTCTTTCAGACGGGAGCACCTGACCTCCGTGACACTGTCCATCAGAGCTGACTTCCCTG |
| | | TCCCTAGCATAACTGACATTGGACATCCCGCCCCTAATGTGAAAAGGATAAGATGCTCCGC |
| | | CTCTGGAGATTTTCCAGAGCCTCGCCTCGCCTGGATGGAAGATGGAGAAGAACTAAACGCC |
| | | GTCAACACGACGGTTGACCAGGATTTGGACACGGAGCTCTACAGCGTCAGCAGTGAACTGG |
| | | ATTTCAATGTGACAAATAACCACAGCATCGTGTGTCTCATCAAATACGGGGAGCTGTCGGT |
| | | GTCACAGATCTTCCCTTGGAGCAAACCCAAGCAGGAGCCTCCCATTGATCAGCTTCCATTC |
| | | TGGGTCATTATCCCAGTAAGTGGTGCTTTGGTGCTCACTGCGGTAGTTCTCTACTGCCTGG |
| | | CCTGCAGACATGTTGCGAGGTGGAAAAGAACAAGAAGGAATGAAGAGACAGTGGGAACTGA |
| | | AAGGCTGTCCCCTATCTACTTAGGCTCTGCGCAATCCTCGGGCTGA |
| SEQ ID NO:4 | Round 1 CD28BP-126 (Clone 126) | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAGCACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGATTTGAAAGGGGCTTATAAACTGGAGCACCTGACTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAACGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTCTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGCAACTGAAAGGCTGTCCCCTATCTACTTACGCTCTGCGCAATCCTCGCCCTGA |

-continued

SEQUENCES

| SEQ ID | Clone ID Name | Sequence |
|---|---|---|
| SEQ ID NO:5 | Round 2 (R2) CD28BP-1 | ATGGGTCACACAATGAAGTGGGGATCACTACCACCCAAGCGCCCATGCCTCTGCCTCTCTC AGCTCTTGGTGCTCACTGGTCTTTTTTACTTCTGTTCAGGCATCACCCCAAGAGTGTGAC CAAAAGAGTGAAAGAAACAGTAATGCTATCCTGTGATTACAGCACATCCACTGAAGAACTG ACAAGCCTTCGGATCTATTGGCAAAAGGATAGTAAAATGGTGCTGGCCATCCTGCCTGGAA AAGTGCAGGTGTGGCCTGAGTACAAGAACCGCACCATCACTGACATGAACGATAACCCCCG TATTGTGATCCTGGCTCTGCGCCTGTCGGACAGTGGCACCTACACCTGTGTTATTCAGAAG CCTGTTTTGAAAGGGGCTTATAAACTGGAGCACCTGGCTTCCGTGAGGTTAATGATCAGAG CTGACTTCCCTGTCCCTACCATAAATGATCTTGGAAATCCATCTCCTAATATCAGAAGGCT AATTTGCTCAACCTCTGGAGGTTTTCCAAGGCCCCACCTCTACTGGTTGGAAAATGGAGAA GAATTAAATGCTACCAACACAACAGTTTCCCAAGATCCTGGAACTGAGCTCTACATGATTA GCAGTGAACTGGATTTCAATGTGACAAATAACCACAGCATCGTGTGTCTCATCAAATACGG GGAGCTGTCCGTGTCACAGATCTTCCCTTGGAGCAAACCCAAGCAGGAGCCTCCCATTGAT CAGCTTCCATTCTGGGTCATTATCCCAGTAAGTGGTGCTTTGGTGCTCACTGCGGTAGTTC TCTACTGCCTGGCCTGCAGACATGTTGCGAGGTGGAAAAGAACAAGAAGGAATGAAGAGAC AGTCGGAACTGAAAGGCTGTCCCCTATCTACTTAGGCTCCGCGCAATCCTCGGGCTGA |
| SEQ ID NO:6 | Round 2 CD28BP-2 | ATGGGTCACACAATGAAGTGGCGATCACTACCACCCAAGCGCCCATGCCTCTGGCTCTCTC AGCTCTTGGTGCTCACTGGTCTTTTTTACTTCTGTTCAGGCATCACCCCAAAGAGTGTGAC CAAAAGAGTGAAAGAAACAGTAATGCTATCCTGTGATTACAGCACATCCACTGAAGAACTG ACAAGCCTTCGGATCTATTGGCAAAAGGATAGTAAAATGGTGCTGGCCATCCTGCCTGGAA AAGTGCAGGTGTGGCCTGAGTACAAGAACCGCACCATCACTGACATGAACGATAACCCCCG TATTGTGATCCTGGCTCTGCGCCTGTCGGACAGTGGCACCTACACCTGTGTTATTCAGAAG CCTGTTTTGAAAGGCGCTTATAAACTGGAGCACCTGGCTTCCGTGAGGTTAATGATCAGAG CTGACTTCCCTGTCCCTACCATAAATGATCTTGGAAATCCATCTCCTAATATCAGAAGGCT AATTTGCTCAACCTCTGGAGGTTTTCCAAGGCCCCACCTCTACTGGTTGGAAAATGGAGAA GAATTAAATGCTACCAACACAACACTGTCCCAAGATCCTGAAACCAAGCTCTACATGATTA GCAGTGAACTGGATTTCAATGTGACAAATAACCACAGCATCGTGTGTCTCATCAAATACGG GGAGCTGTCGGTGTCACAGATCTTCCCTTGGACCAAACCCAAGCAGGAGCCCCCCATTGAT CAGCTTCCATTCTGGGTCATTATCCCAGTAAGTGGTGCTTTGGTGCTCACTGCGGTAGTTC TCTACCGCCCGGCCTGCAGACATGTTGCGAGGTGGAAAAGAACAAGAAGGAATGAAGAGAC AGTGGGAACTGAAAGGCTGTCCGCTATCTACTTAGGCTCTGCGCAATCCTCGGGCTGA |
| SEQ ID NO:7 | Round 2 CD28BP-3 | ATGGGTCACACAATGAAGTGGGGATCACTACCACCCAAGCGCCCATGCCTCTGGCTCTCTC AGCTCTTGGTGCTCACTGGTCTTTTTTACTTCTGTTCAGGCATCACCCCAAAGAGTGTGAC CAAAAGAGTGAAAGAAACAGTAATGCTATCCTGTGATTACAAACACATCCACTGAAGAACTG ACAAGCCTTCGGATCTATTGGCAAAAGGATAGTAAAATGGTGCTGGCCATCCTGCCTGGAA AAGTGCAGGTGTGGCCTGAGTACAAGAACCGCACCATCACTGACATGAACGATAACCCCCG TATTGTGATCCTGGCTCTGCGCCTGTCGGACAGTGGCACCTACACCTGTGTTATTCAGAAG CCTGTTTTGAAAGGGGCTTATAAACTGGAGCACCTGGCTTCCGTGAGGTTAATGATCAGAG |

| SEQ ID | Clone ID Name | Sequence |
|---|---|---|
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCTATCTACTTAGGCTCTGCGCAATCCTCGGGCTGA |
| SEQ ID NO:8 | Round 2 CD28BP-4 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTCGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTCTTTTGAAAGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTGCTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCTATCTACTTAGGCTCTGCGCAATCCTCGGGCTGA |
| SEQ ID NO:9 | Round 2 CD28BP-5 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAGCACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACCATAACCCCCG |
| | | TATTGTGATCCTGGCTCTGCGCCTGTCGGACAAGGGCACCTACACCTGCGTGGTTCAGAAG |
| | | CCTGTTTTGAAAGGGCTTATAAACTGGAGCACCTGACTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |

| SEQ ID | Clone ID Name | Sequence |
|---|---|---|
| | | TCTACTGCCTGGCCTGCAGGCATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGCTGA |
| SEQ ID NO:10 | Round 2 CD28BP-6 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGCTTATAAACTGGAGCACCTGGCTTCCGTGAGGTTAATGATCAGAG |
| | | CTGACTTCCCTGTCCCTACCATAAATGATCTTGGAAATCCATCTCGTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAACAGAC |
| | | ACTGGGAACTGAAAGGCTGTCCCCTATCTACTTAGGCTCTGCGCAATCCTCGGCCTGA |
| SEQ ID NO:11 | Round 2 CD28BP-7 | ATGGGTCACACAATGAAGTGCAGATCACTACCACCCAAGCGCCCATGCCTCTGCCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTCCAGGTGTGGCCTGAGTACAAGAACCGCACCATCACTGACATGAACCATAACCCCCG |
| | | TATTGTGATCCTGGCTCTGCGCCTGTCGGACAGTGGCACCTACACCTGTGTTATTCAGAAG |
| | | CCTGTTTTGAAAGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCCGTAGTTC |
| | | TCTACTGCCTGGCCTGCAGACATGTTCCGAGGTGGAAAAGAACAAGAAGGAATGAAGAGAC |
| | | AGTGGCAACTGAAAGGCTGTCCCCTATCTACTTAGGCTCTGCGCAATCCTCGGGATGA |
| SEQ ID NO:12 | Round 2 CD28BP-8 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |

-continued

SEQUENCES

| SEQ ID | Clone ID Name | Sequence |
|---|---|---|
| | | TATTGTGATCCTGGCTCTGCGCCTGTCGGACAGTGGCACCTACACCTGTGTTATTCAGAAG |
| | | CCTGTTTTGAAAGGGGCTTATAAACTGGAGCACCTGGCTTCCGTGAGGTTAATGATCAGAG |
| | | CTGACTTCCCTGTCCCTACCATAACTGACATTGGACATCCCGCCCCTAATGTGAAAAGGAT |
| | | AAGATGCTCCGCCTCTGGAGGTTTTCCAGAGCCTCGCCTCGCCTGGATGGAAGATGGAGAA |
| | | GAACTAAACGCCGTCAACACGACGGTTGACCAGGATTTGGACACGGAGCTCTACAGCGTCA |
| | | GCAGTGAACTGGATTCCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGCAAAAGAACAAGAAGGAATGAAGAGAC |
| | | AGTGGGAACTGAAAGGCTGTCCCTATCTACTTAGGCTCTGCGCAATCCTCGGGCTGA |
| SEQ ID NO:13 | Round 2 CD28BP-9 | ATCGGTCACACAATGAAGTGGGGATCACTACCACCCAAGCGCCCATGCCTCTGCCTCTCTC |
| | | AGCTCTTGGTGCTCACTGCTCTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAACGCTGTCCCCTATCTACTTAGGCTCTGCGCAATCCTCGGGCTGA |
| SEQ ID NO:14 | Round 2 CD28BP-10 | ATGGGTCACACAATGAAGTGGCGATCACTACCACCCAAGCGCCCATGCCTCTGGCTCTCTC |
| | | AGCTCTTGGTGCTCACTGGTCTTTTTACTTCTGTTCAGGCATCACCCCAAAGAGTGTGAC |
| | | CAAAAGAGTGAAAGAAACAGTAATGCTATCCTGTGATTACAGCACATCCACTCAGGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGGCTTATAAACTGGAGCACCTGACTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACACTGTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |

| SEQ ID | Clone ID Name | Sequence |
|---|---|---|
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTGA |
| SEQ ID NO:15 | Round 2 CD28BP-11 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACGCATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCCCCTGTCGGACAAGGGCACCTACACCTGCGTGGTTCAGAAG |
| | | AATGAGAACGGGTCTTTCAGACGGGAGCACCTGACCTCCGTGACACTGTCCATCAGAGCTG |
| | | ACTTCCCTGTCCCTAGCATAACTGACATTGGACATCCCGCCCCTAATGTGAAAAGGATAAG |
| | | ATGCTCCGCCTCTGGAGGTTTTCCAGAGCCTCGCCTCGCCTGGATGGAAGATGGAGAAGAA |
| | | CTAAACGCCGTCAACACGACGGTTGACCAGGATTTGGACACGGAGCTCTACAGCGTCAGCA |
| | | GTGAACTGGATTTCAATGTGACAAATAACCACAGCATCGTGTGTCTCATCAAATACGGGGA |
| | | GCTGTCGGTGTCACAGATCTTCCCTTGGAGCAAACCCAAGCAGGAGCCTCCCATTGATCAG |
| | | CTTCCATTCTGGGTCATTATCCCAGTAAGTGGTGCTTTGGTGCTCACTGCGGTAGTTCTCT |
| | | ACTGCCTGGCCTGCAGACATGTTGCGAGGTGGAAAAGAACAAGAAGGAATGAAGAGACAGT |
| | | GGGAACTGAAAGGCTGTCCCCTATCTACTTAGGCTCTGCGCAATCCTCGGGCTGA |
| SEQ ID NO:16 | Round 2 CD28BP-12 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAGCACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | ACTGGGAACTGAAAGGCTGTCCCCTATCTACTTAGGCTCTGCGCAATCCTCGGGCTGA |
| SEQ ID NO:17 | Round 2 CD28BP-13 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAGCACATCCACTGAAGAACTG |
| | | ACTAGCCTTCGGATCTATTGGCAAAAGGATAGTAAAATGGTGCTGGCCATCCTGCCTGGAA |

-continued

SEQUENCES

| SEQ ID | Clone ID Name | Sequence |
|---|---|---|
| | | AAGTGCAGGTGTGGCCTGAGTACAAGAACCGCACCATCACTGACATGAACGATAACCCCCG |
| | | TATTGTGATCCTGGCTCTCCGCCTGTCGGACAGTGGCACCTACACCTGTGTTATTCAGAAG |
| | | CCTGTTTTGAAAGGGCCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAGAGCCTCCCCTCGCCTGGATGGAAGATGGAGAA |
| | | GAACTAAACGCCGTCAACACGACGGTTGACCAGGATTTGGACACGGAGCTCTACAGCGTCA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTGA |
| SEQ ID NO:18 | Round 2 CD28BP-14 | ATGGGCCACACGCTGAGGCCGGGAACTCCACTGCCCAGGTGTCTACACCTCAAGCTCTGCC |
| | | TGCTCTTCGCGCTGGCGGGTCTCCACTTCTCTTCAGGTATCAGCCAGGTCACCAAGTCGGT |
| | | GAAAGAAATGGCGGCACTGTCCTGTGATTACAACATTTCTATCGATGAACTGCCGAGAATG |
| | | CGCATATACTGGCAGAAGGACCAACAGATGGTGCTGAGCATCATCTCTGGGCAAGTGGAAG |
| | | TGTGGCCTGAGTACAAGAACCGCACCATCACTGACATGAACGATAACCCCCGTATTGTGAT |
| | | CCTGGCTCTGCGCCTGTCGGACAGTGGCACCTACACCTGTGTTATTCAGAAGCCTGTTTTG |
| | | AAAGGGGCTTATAAACTGGAGCACCTGGCTTCCGTGAGGTTAATGATCAGAGCTGACTTCC |
| | | CTGTCCCTACCATAAATCATCTTGGAAATCCATCTCCTAATATCAGAAGGCTAATTTGCTC |
| | | AACCTCTGGAGGTTTTCCAAGGCCCCACCTCTACTGGTTGGAAAATGGAGAAGAATTAAAT |
| | | GCTACCAACACAACAGTTTCCCAAGATCCTGGAACTGAGCTCTACATGATTAGCAGTGAAC |
| | | TGGATTTCAATGTGACAAATAACCACAGCATCGTGTGTCTCATCAAATACGGGGAGCTGTC |
| | | GGTGTCACAGATCTTCCCTTGGAGCAAACCCAAGCAGGAGCCTCCCATTGATCAGCTTCCA |
| | | TTCTGGGTCATTATCCCAGTAAGTGGTGCTTTGGTGCTCACTGCGGTAGTTCTCTACTGCC |
| | | TGGCCTGCAGACATGTTGCGAGGTGGAAAAGAACAAGAAGGAATGAAGAGACAGTGGGAAC |
| | | TGAAAGGCTGTCCCCTATCTACTTAGGCTCTGCGCAATCCTCGGGCTGA |
| SEQ ID NO:19 | Round 2 CD28BP-15 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCCGTCGGACAGTGGCACCTACACCTGTGTTATTCAGAAG |
| | | CCTGTTTTGAAAGGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |

-continued

SEQUENCES

| SEQ ID | Clone ID Name | Sequence |
|---|---|---|
| | | GGAGCTGTCGGTGTCACAGATCTTCCCTTGGAGCAAACCCAAGCAGGAGCCTCCCATTGAT |
| | | CAGCTTCCATTCTGCGTCATTATCCCAGTAAGTGGTGCTTTCGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTGA |
| SEQ ID NO:20 | Round 2 CD2SEP-16 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATCCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCACTGCGCCTGTCGGACAGTGGCACCTACACCTGTGTTATTCAGAAG |
| | | CCTGTTTTGAAAGGGCTTATAAACTCGAGCACCTGACTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCGCTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTGA |
| SEQ ID NO:21 | Round 2 CD28BP-17 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCACGCATCACCCCAAAGAGTGTGAC |
| | | CAAAAGAGTGAAAGAAACAGTAATGCTATCCTGTGATTACAGCACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAAAACCGCACCTTCCCCGACATCATTAACAACCTCTC |
| | | CCTTATGATCCTGGCACTGCGCCTGTCGGACAAGGGCACCTACACCTGCGTGCTTCAGAAG |
| | | AATGAGAACGGGTCTTTCAGACGGGAGCACCTGACCTCCGTGACACTGTCCATCAGAGCTG |
| | | ACTTCCCTGTCCCTAGCATAACTGACATTGGACATCCCGCCCCTAATGTGAAAAGGATAAG |
| | | ATGCTCCGCCTCCGGAGATTTTCCAGAGCCTCGCCTCGCCTGGATGGAAGATGGAGAAGAA |
| | | CTAAACGCCGTCAACACGACGGTTGACCAGGATTTGGACACGGAGCTCTACAGCGTCAGCA |
| | | GTGAACTGGATTTCAATGTGACAAATAACCACAGCATCGTGTGTCTCATCAAATACCGGGA |
| | | GCTGTCGGTGTCACAGATCTTCCCTTGGAGCAAACCCAAGCAGGAGCCTCCCATTGATCAG |
| | | CTTCCATTCTGGGTCATTATCCCAGTAAGTGGTGCTTTGGTGCTCACTGTGGTAGTTCTCT |
| | | ACTGCCTGGCCTGCAGACATGTTGCGAGGTGGAAAAGAACAAGAAGGAATGAAGAGACAGT |
| | | GGGAACTGAAAGGCTGTCCCCTATCTACTTAGGCTCTCCGCAATCCTCGGGCTGA |
| SEQ ID NO:22 | Round 1 (R1) CTLA4BP-5 | ATGGGCCACACACGGAGGCAGGGAATATCACCATCCAAGTGTCCATACCTCAAGTTCTTTC |
| | | AGCTCTTGGTGCTGGCTCGTCTTTCTCACTTCTGTTCAGGTGTTATCCACGTGACCAAGGA |
| | | AGTGAAAGAAGTGGCAACGCTGTCCTGTGGTCACAATGTTTCTGTTGAAGAGCTGGCACAA |

-continued

SEQUENCES

| SEQ ID | Clone ID Name | Sequence |
|---|---|---|
| | | ACTCGCATCCACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGATGCTTTCAAGCGGGAACACCTGGCTGAAGTGACGTTATCAGTCAAAGCTGACTTCC |
| | | CTACACCTAGTATATCTGACTTTGAAATTCCACCTTCTAACATTAGAAGGATAATTTGCTC |
| | | AACCTCTGGAGGTTTTCCTGAGCCTCACCTCTCCTGGCTGGAAAATGGAGAAGAATTAAAT |
| | | GCCATCAACACAACACTTTCCCAAGATCCTGGAACTGAGCTCTATACTGTTAGCAGCAAAC |
| | | TGGATTTCAATATGACAACCAACCACAGCTTCATGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTCGGCCATTACCTTAATCTCAGTAAATGGAATTTTTGTGATATGCTGCCTGACCT |
| | | ACTGCTTTGCCCCAAGATGCAGAGAGAGAAGGAGGAATGAGAGATTGAAAGGGAAAGTGT |
| | | ACGCCCTGTATGA |
| SEQ ID NO:23 | Round 1 CTLA4BP-7 | ATGGGCCACACACGGAGGCAGGGAATATCACCATCCAAGTGTCCATACCTCAATTTCTTTC |
| | | AGCTCTTGGTGCTGGCTTGTCTTTCTCATTTCTGTTCAGGTGTTATCCACGTGACCAAGGA |
| | | AGTGAAAGAAGTGGCAACGCTGTCCTGTGGTCACAATGTTTCTGTTGAAGAGCTGGCACAA |
| | | ACTCGCATCTACTGGCAAAAGGGGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGATGCTTTCAAGCGAGAACACCTGGCTGAAGTGACGTTATCAGTCAAAGCTGACTTCC |
| | | CTACACCTAGTATAACTGACTTTGAAATTCCACCTTCTAACATTAGAAGGATAATTTGCTC |
| | | AACCTCTGGAGGTTTTCCAGAGCCTCGCCTCTCCTGGTTGGAAAATGGAGAAGAATTAAAT |
| | | GCCATCAACACAACAGTTTCCCAAGATCCTGAAACTGAGCTCTATGCTGTTAGCAGCAAAC |
| | | TGGATTTCAATATGACAACCAACCACAGCTTCATGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCCTAATCTCAGTAAATGGAATTTTTGTGATATGCTGCCTGACCT |
| | | ACTGCTTTGCCCCAAGATGCAGAGAGAGAAGGAGGAATGAGAGATTGAAAGGGAAAGTGT |
| | | ACGCCCTGTATGA |
| SEQ ID NO:24 | Round 1 CTLA4BP-11 | ATGACCCACACACGGAGGCAGGGAACATCACCATCCAAGTGTCCGTACCTCAAGTTCTTTC |
| | | AGCTCTTGGTGCTGGCTAGTCTTTCTCACTTCTGTTCAGGTGTTATCCACATGACCAAGGA |
| | | AGTGAAAGAAGTGGCAACACTGTCCTGTGGTCACAATGTTTCTGTTGAAGAGCTGGCACAA |
| | | ACTCGCATCTACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGATGCTTTCAAGCGAGAACACCTGGCTGAAGTGATGTTATCCGTCAAAGCTGACTTCC |
| | | CTACACCTAGTATAACTGACTTTGAAATTCCACCTTCTAACATTAGAAGGATAATTTGCTC |
| | | AACCTCTGGAGGTTTTCCAGAGCCTCACCTCTTCTGGCTGGAAAATGGAGAAGAATTAAAT |
| | | GCCATCAACACAACAGTTTCCCAAGATCCTGAAACTGAGCTCTATGCTGTTAGCAGCAAAC |

-continued

SEQUENCES

| SEQ ID | Clone ID Name | Sequence |
|---|---|---|
| | | TGGATTTCAATATGACAACCAACCACAGCTTCATGTGTCTCATCAAGTATGGACATTTAAG |
| | | AGTGAATCAGACCTTCAACTGGAATACAACCAAGCAAGAGCATTTTCCTGATAACCTGCTC |
| | | CCATCCTGGGCCATTACCCTAATCTCAGTAAATGGAATTTTTGTGATATGCTGCCTGACCC |
| | | ACTGTTTTGCCCCAAGATGCAGAGAGAGAAGGAGGAATCAGAGATTGAGAAGGGAAAGTGT |
| | | ACACCCTGTATGA |
| SEQ ID NO:25 | Round 1 CTLA4BP-13 | ATGGGCCACACACGGAGGCAGGGAATATCACCATCCAAGTGTCCATACCTCAAGTTCTTTC |
| | | ACCTCTTGGTGCTGGCTTGTCTTTCTCATTTCTGTTCAGGTGTTATCCACGTGACCAAGGA |
| | | AGTGAAAGAAGTGGCAACACTGTCCTGTCGTCACAATGTTTCTGTTGAAGAGCTGGCACAA |
| | | ACTCGCATCTACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGACGCTTTCAAGCGGGAACACCTAGCTGAAGTGACGTTATCAGTCAAAGCTGACTTCC |
| | | CTACACCTAGTATATCTGACTTTGAAATTCCAACTTCTAATATTAGAAGGATAATTTGCTC |
| | | AACCTCTGGAGGTTTTCCAGAGCCTCACCTCTTCGGGTTGGAAAATGGGGAAGAAATAAAT |
| | | GCCATCAACACAACAGCTTCCCAAGATCCTGAAACTGAGCTCTATACTGTTAGCAGCAAAC |
| | | TGGATTTCAATATGACACCCAATCGCAGTTTTGTCTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGCAAATGGAATTTTTGTGATATGCTGCCTGACCT |
| | | ACTGCTTTGCCCCAAGATGCAGAGAGAGAAAGAGCAATGAGAGACTGAGAAGGGAAAGTGT |
| | | ACGCCCTGTATGAG |
| SEQ ID NO:26 | Round 1 CTLA4BP-27 | ATGAGCCACACACGGAGGCAGGGAATATCACCATCCAAGTGTCCATACCTCAATTTCTTTC |
| | | AGCTCTTGGTGCTGGCTAGTCTTTCTCATTTCTGTTCAGGTGTTATCCACGTGACCAAGGA |
| | | AGTGAAAGAAGTGGCAACGCTGTCCTGTGGTCTCAATGTTTCTGTTGAAGAGCTGGCACAA |
| | | ACTCGCATCTACTGCCAAAAGGAGAAGAAAATGGTGCTGACTATGATGTCTGGGGACATGA |
| | | ATATATGGCCCCAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGACGCTTTCAAGCGAGAACACCTGGCTGAAGTGATGTTATCCGTCAAAGCTGACTTCC |
| | | CTACACCTAGTATATCTGACTTTGAAATTCCACCTTCTAACATTAGAAGGATAATTTGCTC |
| | | AACCTCCGGAGGTTTTCCTGAGCCTCACCTCTCCTGGCTGGAAAATGGAGAAGAATTAAAT |
| | | GCCATCAACACAACAGTTTCCCAAGATCCTGAAACTGAGCTCTATACTGTTAGCAGCAAAC |
| | | TGGATTTCAATATGACAGCCAATCACAGTTTTGTGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGTAAATGGAATTTTTGTGATATGCTGCCTGACCT |
| | | ACTGCTTTGCCCCAAGATGCAGAGAGAGGAGAAGGAATGAGACACTGAGAAGGGAAAGTGT |
| | | ACGCCCTGTATGA |

| SEQ ID | Clone ID Name | Sequence |
|---|---|---|
| SEQ ID NO:27 | Round 2 CTLA4BP- 5x2-10c | ATGGGCCACACACGGAGGCAGGGAATATCACCACCCAAGTGTCCATACCTCAATTTCTTTC<br>AGCTCTTCGTGCTGGCTTGTCTTTCTCATTTCTGTTCAGGTGTTATCCACGTGACTAACGA<br>AGTGAAAGAAGTGGCAACACTGTCCTGTGGTCACAAAGTTTCTGTTGAAGAGCTGGCACAA<br>ACTCGCATCCACTGGCAAAAGGAGAAGAAAATGGTGCTGACTATGATGTCCGGGGACATGA<br>ATATATGGCCCGAGTACAAGAACCGGACCATCTTTGATATCACTAATAACCTCTCCATTGT<br>GATTCTGGCTCTGCCCCCATCTGACGAGGGCACATACGAGTGTGTTGTTCTGAAGTATGAA<br>AAAGACGCTTTCAAGCGGGAACACCTCGCTGAAGTGATGTTATCCGTCAAAGCTGACTTCC<br>CTACACCTAGTATAACTGACTTTGAAATTCCACCTTCTAACATTAGAAGGATAATTTGCTC<br>AACCTCTGGAGGTTTTCCTGAGCCTCACCTCTCCTGGCTGGAAAATGGAGAAGAATTAAAT<br>GCCATCAACACAACAGTTTCCCAAGATCCTGAAACTGAGCTCTATACTGTTAGCAGCAAAC<br>TGCATTTCAATATGACAGCCAATCACAGTTTTGTGTGTCTCATCAAGTATGGACATTTAAG<br>AGTGAATCAGACCTTCAACTGGAATACACCCAAGCAAGAGCATTTTCCTGATAACCTGCTC<br>CCATCCTGGGCCATTACCTTAATCTCAGTAAATGGAATTTTTGTGATATGCTGCCTGACCT<br>ACTGCTTTGCCCCAAGATGCAGAGAGAGAAGGAATGAGACACTGAGAAGGGAAAGTGTACG<br>CCCTGTATGAC |
| SEQ ID NO:28 | Round 2 CTLA4BP- 5x2-11d | ATGAGCCACACACGGAGGCAGGCAATATCACCATCCAAGTGTCCATACCTCAAGTTCTTTC<br>AGCTCTTGGTGCTGGCTTGTCTTTCTCATTTCTGTTCAGGTGTTATCCACGTGACCAAGGA<br>AGTGAAAGAAGTGGCAACACTGTCCTGTGGTCACAATGTTTCTGTTGAAGAGCTGGCACAA<br>ACTCGCATCCACTGGCAAAAGGAGAAGAAAATGGTGCTGACTATGATGTCTGGGGACATGA<br>ATATATGGCCCGAGTACAAGAACCGGACCATCTTTGATATCACTAATAACCTCTCCATTGT<br>GATTCTGGCTCTGCGCCCATCTGACGAGGGCACATACGAGTGTGTTGTTCTGAAGTATGAA<br>AAAGACGCTTTCAAGCGAGAACACCTGGCTGAAGTGATGTTATCCGTCAAAGCTGACTTCC<br>CTACACCTAGTATAACTGACTTTGAAATTCCACCTTCTAACATTAGAAGGATAATTTGCTC<br>AACCTCTGGAGGTTTTCCAGAGCCTCACCTCTTCTGGCTGGAAAATGGGGAAGAATTAAAT<br>GCCATCAACACAACAGTTTCCCAAGATCCTGAAACTGAGCTCTATACTGTTAGCAGCAAAC<br>TGGATTTCAATATGACAACCGATCGCAGTTTTGTGTGTCTCATCAAGTATGGACATTTAAC<br>AGTGAATCAGACCTTCAACTGGAATACACCCAAGCAAGAGCATTTTCCTGATAACCTGCTC<br>CCATCCTGGGCCATTACCTTAATCTCAGCAAATGGAATTTTTGTGATATGCTGCCTGACCT<br>ACTGCTTTGCCCCAAGATGCAGAGACAGAAAGAGCAATGAGACACTGAGAAGGGAAAGTGT<br>ACGCCCTGTATGAAA |
| SEQ ID NO:29 | Round 2 CTLA4BP- 5x2-12F | ATGAGCCACACACGGAGGCAGGGAATATCACCATCCAAGTGTCCGTACCTCAAGTTCTTTC<br>AGCTCTTGGTGCTGGCTAGTCTTTCTCATTTCTGTTCAGGTGTTATCCACGTGACCAAGGA<br>AGTGAAAGAAGTGGCAACGCTGTCCTGTGGTCACAATGTTTCTGTTGAAGAGCTGGCACAA<br>ACTCGCATCCACTGGCAAAAGGAGAAGAAAATGGTGCTGACCATGATGTCTGGGGACATGA<br>ATATATGGCCCGAGTACAAGAACCGGACCATCTTTGATATCACTAATAACCTCTCCATTGT<br>GATTCTGGCTCTGCGCCCATCTGACGAGGGCACATACGAGTGTGTTGTTCTGAAGTATGAA<br>AAAGACGCTTTCAAGCGAGAACACCTAGCTGAAGTGACGTTATCAGTCAAAGCTGACTTCC |

| SEQ ID | Clone ID Name | Sequence |
|---|---|---|
| | | CTACACCTAGTATAACTGACTTTGAAATTCCACCTTCTAACATTAAAAGGATAATTTGCTC |
| | | AACCTCCGCAGGTTTTCCTGAGCCTCACCTCTCCTGGCTGGAAAATGGCGAAGAATTAAAT |
| | | GCCATCAACACAACAGTTTCCCAAGATCCTGAAACTGAGCTCTATACTGTTAGCAGCAAAC |
| | | TGGATTTCAATATGACAACCAACCACAGCTTCATGTGTCTCATCAAGTATGGACATTTAAG |
| | | AGTGAATCAGACCTTCAACTGGAATACACCCAAGCAAGAGCATTTTCCTGATAACCCACTC |
| | | CCATCCTGCGCCATTACCTTAATCTCAGCAAATGGAATTTTTGTGATATGCTGCCTGACCT |
| | | ACTGCTTTGCCCCAAGATGCAGAGAGAGGAGAAGGAATGAGACACTGAGAAGGGAAAGTGT |
| | | ACGCCCTGTATGA |
| SEQ ID NO:30 | Round 2 CTLA4BP-5x2-2g | ATGGGCCACACACGGAGGCAGGGAACATCACCATCCAAGTGTCCGTACCTCAAGTTCTTTC |
| | | AGCTCTTGGTGCTGGCTTGTCTTTCTCATTTCTGTTCAGGTGTTATCCACGTGACCAAGGA |
| | | AGTGAAAGAAGTGGCAACACTGTCCTGTGGTCACAATGTTTCTGTTGAAGAGCTGGCACAA |
| | | ACTCGCATCCACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGACGCTTTCAAGCGGGAACACCTGCCTGAAGTGATGTTATCCGTCAAAGCTGACTTCC |
| | | CTACACCTAGTATAACTGACTTTGAAATTCCAACTTCTAACATTAGAAGGATAATTTGCTC |
| | | AACCTCCGGAGGTTTTCCTGAGCCTCACCTCTCCTGGCTGGAAAATGGAGAAGAATTAAAT |
| | | GCCATCAACACAACAGTTTCCCAAGATCCTGAAACTGAGCTCTATACTGTTAGCAGCAAAC |
| | | TGGATTTCAATATGACAACCAACCACACCTTCATGTGTCTCATCAAGTATGGACATTTAAG |
| | | AGTGAATCAGACCTTCAACTGGAATACACCCAAGCAAAAGCATTTTCCTGATAACCTGCTC |
| | | CCATCCTGGGCCATTACCTTAATCTCAGTAAATGGAATTTTTGTGATATGCTGCCTGACCT |
| | | ACCGCTTTGCCCCAAGATGCAGAGAGAGAAAGAGCAATGAGAGACTGAGAAGGGAAAGTGT |
| | | ACGCCCTGTATGAC |
| SEQ ID NO:31 | Round 2 CTLA4BP-5x2-3c | ATGGGCTACACACGGAGGCAGGGAACATCACCATCCAAGTGTCCGTACCTCAAGTTCTTTC |
| | | AGCTCTTGGTGCTGGCTTGTCTTTCTCATTTCTGTTCAGGTGTTATCCACGTGACCAGGGA |
| | | AGTGAAAGAAGTGGCAACACTGTCCTGTGGCCACAATGTTTCTGTTGAAGAGCTGGCACAA |
| | | ACTCGCATCCACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGACGCTTTCAAGCGGGAACACCTAGCTGAAGTGATGTTATCCGTCAAAGCTGACTTCC |
| | | CTACACCTAGTATATCTGACTTTGAAATTCCAACTTCTAATATTAGAAGGATAATTTGCTC |
| | | AACCTCTGGAGGTTTTCCTGAGCCTCACCTCTCCTGGCTGGAAAATGGACAAGAATTAAAT |
| | | GCCATCAACACAACAGTTTCCCAAGATCCTGAAACTGGGCTCTATACTGTTAGCAGCAAAC |
| | | TGGATTTCAATATGACAACCAACCACAGCTTCATGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGTAAATGGAATTTTTGTGATATGCTGCCTGACCT |

-continued

| SEQ ID | Clone ID Name | Sequence |
|---|---|---|
| | | ACTGCTTTGCCCCAAGATGCAGAGAGAGAAGGAGGAATGAGAGATTGAGAAGGGAAAGTGT ATGCCCTGTATAAG |
| SEQ ID NO:32 | Round 2 CTLA4BP- 5x2-4C | ATGAGCCACACACGGAGGCAGGGAACATCACCATCCAAGTGTCCGTACCTCAAGTTCTTTC AGCTCTTGGTGCTGGCTAGTCTTTCTCATTTCTGTTCAGGTGTTATCCACGTGACCAAGGA AGTGAAAGAAGTGGCAACACTGTCCTGTGGTCTCAATGTTTCTGTTGAAGAGCTGGCACAA ACTCGCATCTACTGGCAAAAGGAGAAGAAAATGGTGCTGACTATGATGTCTGGGGACATGA ATATATGGCCCGAGTACAAGAACCGGACCATCTTTGATATCACTAATAACCTCTCCATTGT GATTCTGGCTCTGCGCCCATCTGACGAGGGCACATACGAGTGTGTTGTTCTGGAGTATGAA AAAGACGCTTTCAAGCGGGAACACCTGGCTGGCTGGATCTTATCCGTCAAAGCTGACTTCC CTACACCTAGTATATCTGACTTTGAAATTCCACCTTCTAACATTAGAACGATAATTTGCTC AACCTCTGGAGGTTTTCCTGAGCCTCACCTCTCCTGGCTGGAAAATGGGGAAGAATTAAAT GGCATCAACACAACAGTTTCCCAAGATCCTGAAACTGAGCTCTATACTGTTAGCAGCAAAC TGGATTTCAATATGACAACCAATCGCAGTTTTGTGTGTCTCATCAAGTATGGACATTTAAG AGTGAATCAGACCTTCAACTGGAATACACCCAAGCAAGAGCATTTTCCTGATAACCTGCTC CCATCCTGGGCCATTACCTTAATCTCAGTAAATGGAATTTTTGTGATATGCTGCCTGACCT ACTGCTTTGCCCCAAGATGCAGAGAGAGGAGGACGAATCAGAGACTGAGAAGGGAAAGTGT ACACCCTGTATGAG |
| SEQ ID NO:33 | Round 2 CTLA4BP- 5x2-7b | ATGAGCCACACACGGAGGCAGGGAATATCACCATCCAAGTGTCCATACCTCAATTTCTTTC GGCTCTTGGTCCTGGCTAGTCTTTGTCATTTCTGTTCAGGTGTTATCCACGTGACCAAGGA AGTGAAAGAAGTGGCAACACTGTCCTGTGGTCACAATGTTTCTGTTGAAGAGCTGGCACAA ACTCGCATCCACTGGCAAAAGGAGAAGAAAATGGTGCTGACTATGATGTCTGGGGACATGA ATATATGGCCCGAGTACAAGAACCGGACCATCTTTGATATCACTAATAACCTCTCCATTGT GATTCTGCCTCTGCGCCCATCTGACGAGGGCACATACGAGTGTGTTGTTCTGAAGTATGAA AAAGACGCTTTCAAGCGAGAACACCTAGCTGAAGTGACGTTATCAGTCAAAGCTGGCTTCC CTACACCTAGTATAACTGACTTTGAAATTCCACCTTCTAACATTAGAAGGATAATTTGCTC AACCTCTGGAGGTTTTCCAGAGCCTCACCTCTCCTGGCTGGAAAATGGAGAAGAATTAAAT GCCATCAACACAACAGTTTCCCAAGATCCTGGAACTCAGCTCTATACTGTTAGCACCAAAC TGGATTTCAATATGACAGCCAATCACAGTTTTGTGTCTCTCATCAAGTATGGACATTTAAG AGTGAATCAGACCTTCAACTGGAATACACCCAAGCAAGAGCATTTTCCTGATAACCTGCTC CCATCCTGGGCCATTACCTTAATCTCAGCAAATGGAATTTTTGTGATATGCTGCCTGACCT ACTGCTTTGCCCCAAGATGCAGAGAGAGAAGGACGAATGAGAGATTGAGAAGGGAAAGTGT ACGCCCTGTATGA |
| SEQ ID NO:34 | Round 2 CTLA4BP- 5x2-8C | ATGAGCCACACACGGAGGCACGGAACATCACCATCCAAGTGTCCATACCTCAAGTTCTTTC AGCTCTTGGTGCTGGCTAGTCTTTCTCACTTCTGTTCAGGTGTTATCCACATGACCAAGGA AGTGAAAGAAGTGGCAACGCTGTCCTGTGGTCACAATGTTTCTGTTGAAGAGCTGGCACAA ACTCGCATCTACTGGCAAAACGAGAAGAAAATGGTGCTGACTATGATGTCTGGGGACATGA ATATATGGCCCGAGTACAAGAACCGGACCATCTTTGATATCACTAATAACCTCTCCATTGT |

-continued

SEQUENCES

| SEQ ID | Clone ID Name | Sequence |
|---|---|---|
| | | GATTCTGGCTCTGCGCCCATCTGACGAGGGCACATACGAGTGTGTTGTTCTGAAGTATGAA |
| | | AAAGACGCTTTCAAGCAGGAACACCTGGCTGAAGTGATGTTATCCGTCAAAGCTGACTTCC |
| | | CTACACCTAGTATAACTGACTTTGAAATTCCACCTTCTAACATTAGAAGGATAATTTGCTC |
| | | AACCTCTGGAGGTTTTCCAGAGCCTCACCTCTTCTGGCTGGAAAATGGAGAGGAATTAAAT |
| | | GCCATCAACACAACAGTTTCCCAAGACCCTGAAACTGAGCTCTATGCTGTTAGCAGCAAAC |
| | | TGGATTTCAATATGACAACCAACCACAGTTTTGTGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGCAAATGGAATTTTTGTGATATGCTGCCTGACCT |
| | | ACTGCTTTGCCCCAAGATGCAGAGAGAGAAGGAGGAATGAGAGATTGAGAAGGGAAAGTGT |
| | | ACACCCTGTATGAT |
| SEQ ID NO:35 | Round 2 CTLA4EP- 5x3-10e | ATGGGCTACACACGGAGGCAGGGAATATCACCATCCAAGTGTCCATACCTCAAGTTCTTTC |
| | | AGCTCTTGGTGCTGGCTTGTCTTTCTCATTTCTGTTCAGGTGTTATCCACGTGACCAAGGA |
| | | AGTGAAAGAAGTGGCAACACTGTCCTGTGGTCACAATGTTTCTGTTGAAGAGCTGGCACAA |
| | | ACTCGCATCTACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTCACGAGGGCACATACGAGTGTGTTGTTCTGGAGTATGAA |
| | | AAAGACGCTTTCAAGCGGGAACACCTGGCTGAGTGACGTTATCAGTCAAAGCTGACTTCC |
| | | CTACACCTAGTATATCTGACTTTGAAATTCCACCTTCTAACATTAGAAGGATAATTTGCTC |
| | | AACCTCTGGAGGTTTTCCAGAGCCTCACCTCTTCTGGCTGGAAAATGGAGAAGAATTAAAT |
| | | GCCATCAACACAACAGTTTCCCAAGATCCTGAAACTCAGCTCTATGCTGTTAGCAGCAAAC |
| | | TGGATTTCAATATGACAACCAACCACAGCTTCATGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGCAAATGGAATTTTTGTGATATGCTGCCTGACCT |
| | | ACTGCTTTGCCCCAAGATGCAGAGAGAGGAGCAATGAGAGACTGAGAAGGGAAAGTGT |
| | | ACACCCTGTATGAT |
| SEQ ID NO:36 | Round 2 CTLA4BP- 5x3-11b | ATGAGCCACACACGGAGGCAGGGAATATCACCATCCAAGTGTCCATACCTCAAGTTCTTTC |
| | | AGCTCTTGGTCCTGGCTTGTCTTTCTCATTTCTGTTCAGCTGTTATCCACGTGACCAAGGA |
| | | AGTGAAAGAAGTGGCAACGCTGTCCTGTGGTCACAATGTTTCTGTTGAAGAGCTAGCACAA |
| | | ACTCGCATCTACTGGCAAAAGGAGAAGAAAATGGTGCTGACTATGATGTCTGGGGACATGA |
| | | ATATATGGCCCGAGTACAGAACCGGACCATCTTTGATATCACTAAATAACCTCTCCATTGT |
| | | GATTCTGGCTCTGCGCTCATCTGACGAGGGCACATACGAGTGTGTTGTTCTGAGTAATGAA |
| | | AAAGACGCTTTCAAGCGGGAACACCTAGCTGAAGTGACGTTATCAGTCAAAGCTGACTTCC |
| | | CTACACCTAGTATAACTGACTTTGAAATTCCACCTTCTAACATTAGAAGGATAATTTGCTC |
| | | AACCTCTGGAGGTTTTCCTGAGCCTCACCTCTCCTGGCTGGAAAATGGAGAAGAATTAAATT |
| | | GCCATCAGCACAACAGTTTCCCAAGATCCTGAAACTGAGCTCTACACTGTTAGCAGCAAAC |
| | | TGGATTTCAATATGACAACCAATCGCAGTTTTGTGTGTCTCATCAAGTATGGACATTTAAC |
| | | AGTGAATCAGACCTTCAACTGGAATACACCCAAGCAAGAGCATTTTCCTGATAACCTGCTC |

-continued

SEQUENCES

| SEQ ID | Clone ID Name | Sequence |
|---|---|---|
| | | CCATCCTGGGCCATTACCCTAATCTCAGTAAATGGAATTTTTGTGATATGCTGCCTGACCT |
| | | ACTGCTTTGCCCCAAGATGCAGAGAGAGAAGAGCAATGAGAGACTGAGAAGGGAAAAGTGT |
| | | ACGCCCTGTATGAA |
| SEQ ID NO:37 | Round 2 CTLA4BP- 5x3-6f | ATGGGCCACACACCGAGGCAGGGAATATCACCATCCAAGTGTCCGTACCTCAATTTCTTTC AGCTCTTCGTGCTAGCTGGTCTTTCTCACTTCTGTTCAGGTGTTATCCACGTGACCAAGGA AGTGAAAGAAGTGGCAACACTGTCCTGTGGTCACAATGTTTCTGTTGAAGAGCTGGCACAA ACTCCCATCTACTGGCAAAAGGGGAACAAAATGGTGCTGACTATGATGTCTGGGGACATGA ATATATGGCCCGAGTACAAGAACCGGACCATCTTTGATATCACTAATAACCTCTCCATTGT GATTCTGGCTCTGCGCCCATCTGACGAGGGCACATACGAGTGTGTTGTTCTGGAGTATGAA AAAGACGCTTTCAAGCGAGAACACCTGGCTGAAGTGATGTTATCCGTCAAAGCTGACTTCC CTACACCTAGTATATCTGACTTTGAAATTCCAACTTCTAATATTAGAAGGATAATTTGCTC AACCTCTGGAGGTTTTCCTGAGCCTCACCTCTCCTGGCTGGAAATGGAGAAGAATTAAAT GCCATCAACACAACAGCTTCCCAAGATCCTGAAACTGAGCTCTATACTGTTAGCAGCAAAC TGGATTTCAATATGACAACCAACCACAGCTTCATGTGTCTCATCAAGTATGGACATTTAAG AGTGAATCAGACCTTCAACTGGAATACACCCAAGCAAGAGCATTTTCCTGATAACCTGCTC CCATCCTGGGCCATTACCTTAATCTCAGCAAATGGAATTTTTGTGATATGCTGCCTGGCCT ACTGCTTTGCCCCAGGATGCAGAGAGAGAAAGAGCAATGAGAGACTGAGAAGGGAAAGTGT ACGCCCTGTATGAC |
| SEQ ID NO:38 | Round 2 CTLA4BP- 5x4-11d | ATGCGCCACACACGGAGGCAGGGAATATCACCATCCAAGTGTCCATACCTCAAGTTCTTTC AGCTCTTGGTGCTGGCTTGTCTTTCTCATCTCTGTTCAGGTGTTATCCACGTGACCAAGGA AGTGAAAGAAGTGGCAACACTGTCCTGTGGTCTCAATGTTTCTGTTGAAGAGCTGGCACAA ACTCGCATCCACTGGCAAAAGGAGAAGAAAATGGTGCTGACTATGATGTCTGGGGACATGA ATATATGGCCCGAGTACAAGAACCGGACCATCTTTGATATCACTAATAACCTCTCCATTGT GATTCTGGCTCTGCGCCCATCTGACGAGGGCACATACGAGTGTGTTGTTCTGAAGTATGAT AAAGACGCTTTCAAGCGGGAACACCTCGCTGAAGTGACGTTGTCAGTCAAAGCTGACTTCC CTACACCTAGTATATCTGACTTTGAAATTCCACCTTCTAACATTAGAAGGATAATTTGCTC AACCTCCGGAGGTTTTCCTGAGCCTCACCTCTCCTGGCTGGAAAATGGAGAAGAATTAAAT GCCATCAACACAACAGTTTCCCAAGATCCTGAAACTGAGCTCTATACTGTTAGCAGCAAAC TGGATTTCAATATGACAGCCAATCACAGTTTTGTGTGTCTCATCAAGTATGGACATTTAAG AGTGAATCAGACCTTCAACTGGAATACACCCAAGCAAGAGCATTTTCCTGATAACCTGCTC CCATCCTGCGCCATTACCCTAATCTCAGTAAATGGAATTTTTGTGATATGCTGCCTGACCT ACCGCTTTGCCCCAAGATGCAGAGAGAGAAAGAGCAATGAGAGACTGAGAAGGGAAAGTGT ACGCCCTGTATGA |
| SEQ ID NO:39 | Round 2 CTLA4BP- 5x4-12c | ATGGGCCACACACGGAGGCAGGGAACATCACCATCCAACTGTCCATACCTCAAGTTCTTTC AGCTCTTGGTGCTGGCTCGTCTTTCTCACTTCTGTTCAGGTGTTATCCACGTGACCAAGGA AGTGAAAGAAGTGGCAACGCTGTCCTGTGGTCACAATGTTTCTGTTGAAGAGCTGGCACAA ACTCGCATCCACTGGCAAAAGGAGAAGAAAATGGTGCTGACTATGATGTCTGGGGACATGA |

-continued

SEQUENCES

| SEQ ID | Clone ID Name | Sequence |
|---|---|---|
| | | ATATATGGCCCGAGTACAAGAACCGGACCATCTTTGATATCACTAATAACCTCTCCATCGT |
| | | GATTCTGGCTCTGCGCCCATCTGACGAGGGCACATACGAGTGTGTTGTTCTGAAGTATGAA |
| | | AAAGATGCTTTCAAGCGAGAACACCTGGCTGAAGTGATGTTATCCGTCAAAGCTGACTTCC |
| | | CTACACCTAGTATATCTGACTTTGAAATTCCACCTTCTAACATTAGAAGGATAATTTGCTC |
| | | AACCTCTGGAGGTTTTCCAGAGCCTCACCTCTTCTGGTTGGAAAATGGGGAAGAATTAAAT |
| | | GCCATCAACACAACAGTTTCCCAAGATCCTGAAACTGACCTCTATACTGTTAGCAGCAAAC |
| | | TGGATTTCAATATGACAACCAACCACAGCTTCATGTGTCTCATCAAGTATGGACATTTAAG |
| | | AGTCAATCAGACCTTCAACTGGAATACACCCAAGCAAGAGCATTTTCCTGATAACCTGCTC |
| | | CCATCCTGGGCCATTACCTTAATCTCAGCAAATGGAATTTTTGTGATATGCTGCCTGACCT |
| | | ACCGCTTTGCCCCAAGATGCAGAGAGAGAAAGAGCAATGAGACACTGAGAAGGGAAAGTGT |
| | | ACGCCCTGTATGA |
| SEQ ID NO:40 | Round 2 CTLA4BP-5x4-1f | ATGGGCCACACACGGAGGCAGGGAACATCACCATCCAAGTGTCCGTACCTCAAGTTCTTTC |
| | | ACCTCTTGGTGATGGCTTGTCTTTCTCATTTCTGTTCAGGTGTTATCCACGTGACCAAGGA |
| | | AGTGAAAGAAGTGGCAACACTGTCCTGTGGTCACAATGTTTCTGTTGAAGAGCTGGCACAA |
| | | ACTCGCATCCACTGGCAAAACGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTCACCAGGGCACATACGAGTGTGTTGTTCTGAAGTATGAA |
| | | AAAGACGCTTTCAAGCGAGAACACCTAGCTGAAGTGATGTTATCCGTCAAAGCTCACTTCC |
| | | CTACACCTAGTATATCTGACTTTGAAATTCCAACTTCTAATATTAGAAGGATAATTTGCTC |
| | | AACCTCTGGAGGTTTTCCAGAGCCTCACCTCTTCTGGTTGGAAAATGGGGAAGAATTAAAT |
| | | GCCATCAACACAACACTTTCCCAAGATCCTGAAACTGAGCTCTATACTGTTAGCAGCAAAC |
| | | TGGATTTCAATATGACAACCAACCACAGCTTCATGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCCTAATCTCAGTAAATGGAATTTTTGTGATATGCTGCCTGACCT |
| | | ACTGCTTTGCCCCAAGATGCAGAGAGAGAAGGAGGAATGAGAGATTGAGAAGGGAAAGTGT |
| | | ATGCCCTGTATGAG |
| SEQ ID NO:41 | Round 2 CTLA4BP-5x5-2e | ATGGGCCACACACGGAGGCAGGGAATATCACCATCCAAGTGTCCATACCTCAAGTTCTTTC |
| | | AGCTCTTGGTGCTAGCTTGTCTTTCTCATTTCTGTTCAGGTGTTATCCACGTGACCAAGGA |
| | | AGTGAAAGAAGTGGCAACGCTGTCCTGTGGTCTCAATGTTTCTGTTGAAGAGCTGGCACAA |
| | | ACTCGCATCCACTGGCAAAAGGAGAAGAAAATGGTGCTGACTATGATGTCTGGGGACATGA |
| | | ATATATGGCCCGAGTACAAGAACCCGACCATCTTTGATATCACTAATAAQCTCTCCATTGT |
| | | GATTCTGGCTCTGCGCCCATCTGACGAGGGCACATACGAGTGTGTTGTTCTGAAGTATGAA |
| | | AAAGACGCTTTCAAGCGAGAACACCTGGCTGAACTGATGTTATCCGTCAAAGCTGACTTCC |
| | | CTACACCTACTATATCTGACTTTGAAATTCCACCTTCTAACATTAGAAGGATAATTTGCTC |
| | | AACCTCTGGAGGTTTTCCTGAGCCTCACCTCTCCTGGCTGCAAAATGGAGAAGAATTAAAT |
| | | GCCATCAACACAACAGTTTCCCAAGATCCTGAAACTGAGCTCTATGCTGTTAGCAGCAAAC |
| | | TGGATTTCAATATGACAACCAACCACAGCTTCATGTGTCTCATCAAGTATGGACATTTAAG |

-continued

SEQUENCES

| SEQ ID | Clone ID Name | Sequence |
|---|---|---|
| | | AGTGAATCAGACCTTCAACTGGAATACACCCAAGCAAGAGCATTTTCCTGATAACCTGCTC |
| | | CCATCCTGGGCCATTACCTTAATCTCAGTAAATGGAATTTTTGTGATATGCTGCCTGACCT |
| | | ACTGCTTTGCCCCAAGATGCAGAGAGAGGAGAAGGAATGAGACACTGAGAAGGGAAAGTGT |
| | | ACGCCCTGTATGAC |
| SEQ ID NO:42 | Round 2 CTLA4BP-5x5-6e | ATGGGCCACACACGGAGGCAGGGAATATCACCATCCAAGTGTCCATACCTCAAGTTCTTTC |
| | | AGCTCTTGGTGCTGGCTGGTCTTCCTCATCTCTGTTCAGGTGTTATCCACGTGACCAAGGA |
| | | AGTGAAAGAAGTGCCAACACTGTCCTGTGGTCACAATGTTTCTGTTGAAGAGCTGGCACAA |
| | | ACTCGCATCCACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGATGCTTTCAAGCGGGAACACCTGGCTGAAGTGATGTTATCCGTCAAAGCTGACTTCC |
| | | CTACACCTAGTATAACTGACTTTGAAATTCCACCTTCTAACATTAGAAGGATAATTTGCTC |
| | | AACCTCTGGAGGTTTTCCTGAGCCCCACCTCTCCTGGCTGGAAAATGGAGAAGAATTAAAT |
| | | GCCATCAGCACAACAGTTTCCCAAGATCCTGAAACTGAGCTCTATACTGTTAGCAGCAAAC |
| | | TGGATTTCAATATGACAACCAACCACAGCTTCATGTGTCTCATCAAGTATGGACATTTAAG |
| | | AGTGATCAGACCTTCAACTGGAATACAACCAACCAAGAGCATTTTCCTGATAACCTGCTC |
| | | CCATCCTGGCCCATTACCTTAATCTCAGCAAATGGAATTTTTGTGATATGCTGCCTCACCC |
| | | ACTGTTTTGCCCCAAGATGCAGAGAGAGAACAGGAATGAGAGACTGAGAAGGGAAAGTGT |
| | | ACGCCCTGTATGAC |
| SEQ ID NO:43 | Round 2 CTLA4BP-5x6-9d | ATGAGCCACACACGGAGGCAGGGAACATCACCATCCAAGTGTCCATACCTCAAGTTCTTTC |
| | | AGCTCCTGGTGCTGGCTGGTCTTTCTCATCTCTGTTCAGGTGTTATCCACGTGACCAAGGA |
| | | AGTGAAAGAAGTGGCAACGCTGTCCTGTGGTCACAATGTTTCTGTTGAAGAGCTGGCACAA |
| | | ACTCGCATCCACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAACACGCTTTCAAGCGAGAACACCTGGCTGAAGTGATGTTATCCGTCAAAGCTGACTTCC |
| | | CTACACCTAGTATATCTGACTTTGAAATTCCAACTTCTAACATTAGAAGGATAATTTGCTC |
| | | AACCTCTGCAGGTTTTCCAGAGCCTCACCTCTCCTGGCTGGAAAATGGAGAAGAATTAAAT |
| | | GCCATCAACACAACAGTTTCCCAAGATCCTGAAACTGAGCTCTATACTGTTAGCAGCAAAC |
| | | TGGATTTCAATATGACAGCCAATCACAGTTTTGTGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGTAAATGGAATTTTTGTGATATGCTGCCTGACCT |
| | | ACTCCTTTGCCCCAAGATGCAGAGAGAGAAGGAGGAATGAGAGATTGAGAAGGGAAAGTGT |
| | | ACGCCCTGTATGAT |
| SEQ ID NO:44 | Round 2 CTLA4BP-5x8-1f | ATGGGCCACACACGGAGGCAGGGAATATCACCATCCAAGTGTCCGTACCTCAATTTCTTTC |
| | | AGCTCTTGGTGCTGGCTTGTCTTTCTCATTTCTGTTCAGGTGTTATCCACGTGACCAAGGA |
| | | AGTGAAAGAAGTGGCAACACTGTCCTGTGGTCACAATGTTTCTGTTGAAGAGCTGGCACAA |

-continued

SEQUENCES

| SEQ ID | Clone ID Name | Sequence |
|---|---|---|
| | | ACTCGCATCCACTGGCAAAAGGAGAAGAAAATGGTGCTGACTATGATGTCTGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGACGCTTTCAAGCGGGAACACCTGGCTGAAGTGATGTTATCAGTCAAAGCTGACTTCC |
| | | CTACACCTAGTATAACTGACTTTGAAATTCCACCTTCTAACATTAGAAGGATAATTTGCTC |
| | | AGCCTCTGGAGGTTTTCCAGAGCCTCACCTCTTCTGGCTGGAAAATGGAGAAGAATTAAAT |
| | | GCCATCAACACAACAGTTTCCCAAGATCCTGAAACTGAGCTCTATGCTGTTAGCAGCAAAC |
| | | TGGATTTCAATATGACAACCAACCACAGCTTCATGTGTCTCATCAGGTATGGACATTTAAG |
| | | AGTGAATCACACCTTCAACTGGAATACACCCAAGCAAGAGCATTTTCCTGATAACCTGCTC |
| | | CCATCCTGGGCCATTACCCTAATCTCAGTAAATGGAATTTTTGTGATATGCTGCCTGACCT |
| | | ACTGCTTTGCCCCAAGATGCAGAGAGAGAAAGAGCAATGAGAGACTGAGAAGGGAAAGTGT |
| | | ACGCCCTGTATGA |
| SEQ ID NO:45 | Round 2 CTLA4BP-5x9-12c | ATGGGCCACACACGGAGGCAGGGAACATCACCATCCAAGTGTCCGTACCTCAATTTCTTTC |
| | | AGCTCTTGGTGCTGGCTTGTCTTTCTCATTTCTGTTCAGGTGTTATCCACGTGACCAAGGA |
| | | AGTGAAAGAAGTGGCAACGCTGTCCTGTGGTCACAATGTTTCTGTTGAAGAGCTGGCACAA |
| | | ACTCGCATCCACTGGCAAAAGGAGAAGAAAATGGTGCTGACTATGATGTCTGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGACGCTTTCAAGCGAGAACACCTGGCTGAAGTGATGTTATCCGTCAAAGCTGACTTCC |
| | | CTACACCTAGTATAACTGACTTTCAAATTCCACCTTCTAACATTAGAAGGATAATTTGCTC |
| | | AACCTCCGGAGGTTTTCCAGAGCCTCACCTCTCCTGGCTGGAAAATGGAGAAGAATTAIAT |
| | | GCCATCAACACAACAGCTTCCCAAGATCCTGAAACTGAGCTCTATACTGTTAGCAGCAAAC |
| | | TGGATTTCAATATGACAACCAACCACAGCTTCATGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGTAAATGGAATTTTTGTGATATGCTGCCTGACCT |
| | | ACTGCTTTGCCCCAAGATGCAGAGAGAGAAAGAGCAATGAGAGACTGAGAAGGGAAAGTGT |
| | | ACGCCCTGTATGAG |
| SEQ ID NO:46 | Baboon B7-1 | ATCGGCCACACACGGAGGCAGGGAATATCACCATCCAAGTGTCCATACCTCAAGTTCTTTC |
| | | AGCTCTTGGTGCTGGCTTGTCTTTCTCATTTCTGTTCAGGTGTTATCCACGTGACCAACGA |
| | | AGTGAAAGAAGTGGCAACACTGTCCTGTGGTCACAATGTTTCTGTTGAAGAGCTGGCACAA |
| | | ACTCGCATCTACTGGCAAAAGGAGAAGAAAATGGTGCTGACTATGATGTCTGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGATGCTTTCAAGCGAGAACACCTGGCTGAAGTGATGTTATCCGTCAAAGCTGACTTCC |
| | | CTACACCTAGTATAACTGACTTTGAAATTCCACCTTCTAACATTAGAAGGATAATTTGCTC |
| | | AACCTCTGGAGGTTTTCCAGAGCCTCACCTCTTCTGGTTGGAAAATGGAGAAGAATTAAAT |
| | | GCCATCAACACAACAGTTTCCCAAGATCCTGGAACTGAGCTCTATACTGTTAGCAGCAAAC |

| SEQ ID | Clone ID Name | Sequence |
|---|---|---|
| | | TGGATTTCAATATGACAACCAATCACAGTTTTGTGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCCTAATCTCAGTAAATGGAATTTTTGTGATATGCTGCCTGACCT |
| | | ACTGTTTTGCCCCAAGATGCAGAGAGAGAAGAAGGAATGAGACATTGAGAAGGGAAAGTGT |
| | | ACGCCCTGTATGA |
| SEQ ID NO:47 | Orangutan B7-1 | ATGGGCCACACACGGAGGCAGGGAACATCACCATCCAAGTGTCCATACCTCAATTTCTTTC |
| | | AGCTCTTGGTGCTGGCTAGTCTTTCTCACTTCTGTTCAGGTGTTATCCACGTGACCAAGGA |
| | | AGTGAAAGAAGTGGCAACGCTGTCCTGTGGTCACAATGTTTCTGTTGAAGAGCTGGCACAA |
| | | ACTCGCATCTACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATCCTGGCTCTCCGCCCATCTCACGAGGGCACATATGAGTGTGTTGTTCTGAAGTATGAA |
| | | AAACACGCTTTCAAGCGGGAACACCTGGCTGAAGTGACGTTATCGGTCAAAGCTGACTTCC |
| | | CTACACCTAGTATATCTGACTTTGAAATTCCAACTTCTAATATTAGAAGGATGATTTGCTC |
| | | AACCTCTGGAGGTTTTCCAGAGCCTCACCTCTCCTGGTTGGAAAATGGAGAAGAATTAAAT |
| | | GCCATCAGCACAACAGTTTCCCAAGATCCTGAAACTGAGCTCTATGCTGTTAGCAGCAAAC |
| | | TGGATTTCAATATCACAACCAACCACAGCTTCATCTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGTPAATGGAATTTTTGTGATATGCTGCCTGACCT |
| | | ACTGCTTTGCCCCAAGATGCAGAGAGAGAAGGAGCAATGAGAGACTGAGAAGGGAAAGTGT |
| | | ACGCCCTGTATGA |
| SEQ ID NO:48 | Round 1 CD28BP-71 (Clone 71) | MGHTMKWGSLPPKRPCLWLSQLLVLTGLFYFCSGITPKSVTKRVKETVMLSCDYNTSTEEL |
| | | TSLRIYWQKDSKMVLAILPGKVQVWPEYKNRTITDMNDNPRIVILALRLSDSGTYTCVIQK |
| | | PVLKGAYKLEHLASVRLMIRADFPVPTINDLGNPSPNIRRLICSTSGGFPRPHLYWLENGE |
| | | ELNATNTTLSQDPETKLYMISSELDFNNTSNHSFLCLVKYGDLTVSQTFYWQESKPTPSAN |
| | | QHLTWTIIIPVSAFGISVITAVILTCLTCRNAAIRRQRRENEVEMQSCSQSP |
| SEQ ID NO:49 | Round 1 CD28BP-84 (Clone 84) | MGHTLRPGTPLPRCLHLKLCLLLALAGLHFSSGISQVTKSVKEMAALSCDYNISIDELARM |
| | | RIYWQKDQQMVLSIISGQVEVWPEYKNRTFPDIINNLSLMILALRLSDKGTYTCWQKNEN |
| | | GSFRREHLTSVTLSIRADSPVPSITDIGHPAPNVKRIRCSASGGFPEPRLAWMEDGEELNA |
| | | VNTTVDQDLDTELYSVSSELDFNVTNNHSIVCLIKYGELSVSQIFPWSKPKQEPPIDQLPF |
| | | WVIIPVSGALVLTAVVLYCLACRHVARWKRTRRNEETVGTERLSPIYLGSAQSSG |
| SEQ ID NO:50 | Round 1 CD28BP-118 | MCHTLRPGTPLPRCLHLKLCLLLALAGLHFSSGISQVTKSVKEMAALSCDYNISIDELARM |
| | | RIYWQKDQQMVLSIISGQVEVWPEYKNRTFPDIINNLSLMILALRLSDKGTYTCVVQKNEN |
| | | GSFRREHLTSVTLSIRADFPVPSITDIGHPAPNVKRIRCSASGDFPEPRLAWMEDGEELNA |
| | | VNTTVDQDLDTELYSVSSELDFNVTNNHSIVCLIKYGELSVSQIFPWSKPKQEPPIDQLPF |
| | | WVIIPVSGALVLTAWLYCLACRHVARWKRTRRNEETVGTERLSPIYLGSAQSSG |

-continued

SEQUENCES

| SEQ ID | Clone ID Name | Sequence |
|---|---|---|
| SEQ ID NO:51 | Round 1 CD28BP-126 | MGHTMKWGSLPPKRPCLWLSQLLVLTGLFYFCSGITPKSVTKRVKETVMLSCDYSTSTEEL TSLRIYWQKDSKMVLAILPGKVQVWPEYKNRTITDNNDNPRIVILALRLSDSGTYTCVIQK PDLKGAYKLEHLTSVRLMIRADFPVPTINDLGNPSPNIRRLICSTSGGFPRPHLYWLENGE ELNATNTTVSQDPGTELYMISSELDFNVTNNHSIVCLIKYGELSVSQIFPWSKPKQEPPID QLPFWVIIPVSGALVLTAVVLYCLACRHVARWKRTRRNEETVGTERLSPIYLGSAQSSC |
| SEQ ID NO:52 | Round 2 CD2SBP-1 | MGHTMKWGSLPPKRPCLWLSQLLVLTGLFYFCSGITPKSVTKRVKETVMLSCDYSTSTEEL TSLRIYWQKDSKNVLAILPGKVQVWPEYKNRTITDMNDNPRIVILALRLSDSGTYTCVIQK PVLKGAYKLEHLASVRLMIRADFPVPTINDLGNPSPNIRRLICSTSCGFPRPHLYWLENGE ELNATNTTVSQDPGTELYMISSELDFNVTNNHSIVCLIKYGELSVSQIFPWSKPKQEPPID QLPFWVIIPVSGALVLTAVVLYCLACRHVARWKRTRRNEETVGTERLSPIYLGSAQSSG |
| SEQ ID NO:53 | Round 2 CD28BP-2 | MGHTMKWGSLPPKRPCLWLSQLLVLTGLFYFCSGITPKSVTKRVKETVMLSCDYSTSTEEL TSLRIYWQKDSKNVLAILPGKVQVWPEYKNRTITDMNDNPRIVILALRLSDSGTYTCVIQK PVLKGAYKLEHLASVRLMIRADFPVPTINDLGNPSPNIRRLICSTSGGFPRPHLYWLENGE ELNATNTTLSQDPETKLYNISSELDFNVTNNHSIVCLIKYGELSVSQIFPWSKPKQEPPID QLPFWVIIPVSCALVLTAVVLYRPACRHVARWKRTRRNEETVGTERLSPIYLGSAQSSG |
| SEQ ID NO:54 | Round 2 CD28BP-3 | MGHTMKWGSLPPKRPCLWLSQLLVLTGLFYFCSGITPKSVTKRVKETVMLSCDYNTSTEEL TSLRIYWQKDSKMVLAILPGKVQVPEYKNRTITDMNDNPRIVILALRLSDSGTYTCVIQK PVLKGAYKLEHLASVRLMIPADFPVPTINDLGNPSPNIRRLICSTSGGFPRPHLYWLENGE ELNATNTTVSQDPGTELYMISSELDFNVTNNHSIVCLIKYGELSVSQIFPWSKPKQEPPID QLPFWVIIPVSGALVLTAVVLYCLACRHVARWKRTRRNEETVGTERLSPIYLGSAQSSG |
| SEQ ID NO:55 | Round 2 CD283P-4 | MGHTMKWGSLPPKRPCLWLSQLLVLTGLFYFCSGITPKSVTKRVKETVMLSCDYNTSTEEL TSLRIYWQKDSKMVLAILPGKVQVWPEYKNRTITDSGDNPRIVILALRLSDSGTYTCVIQK PVLKGAYKLEHLASVRLMIPADFPVPTINDLGNPSFNIRRLICSTSGGFPRPHLCWLENGE ELNATNTTVSQDPGTELYMISSELDFNVTNNHSTVCLTKYGELSVSQIFPWSKPKQEPPTD QLPFWVIIPVSGALVLTAVVLYCLACRHVARWKRTRRNEETVGTERLSPIYLGSAQSSG |
| SEQ ID NO:56 | Round 2 CD28BP-5 | MGHTMKWGSLPPKRPCLWLSQLLVLTGLFYFCSGTTPKSVTKRVKETVMLSCDYSTSTEEL TSLRIYWQKDSKMVLAILPGKVQVWPEYKNRTITDMNDNPRIVILALRLSDKGTYTCWQK PVLKGAYKLEHLTSVRLMIEADFPVPTINDLGNPSPNIRRLICSTSGGFPRPHLYWLENGE ELNATNTTVSQDPGTELYMISSELDFNVTNNHSIVCLIKYGELSVSQIFPWSKPKQEPPID QLPFWVIIPVSGALVLTAVXTLYCLACRHVARWKRTRSNEETVGTERLSPIYLGSAQSSG |
| SEQ ID NO:57 | Round 2 CD2855-6 | MGHTMKWGSLPFKRPCLWLSQLLVLTGLFYFCSGITPKSVTKRVKETVMLSCDYNTSTEEL TSLRIYWQKDSKNVLAILPGKVQVWPEYKNRTITDMNDNPRIVILALRLSDSGTYTCVVQK PVLKGAYKLEHLASVRLMIRADFPVFTINDLGNPSPNIRRLICSTSGGFPRPHLYWLENGE ELNATNTTVSQDPGTELYMISSELDFWTIPNHSIVCLIKYGELSVSQIFPWSKPKQEPPID QLPFWVIIPVSGALVLTAWLYCLACRWLARWKRTRRNEETVGTERLSPIYLGSAQSSG |
| SEQ ID NO:58 | Round 2 CD28BP-7 | MGHTMKWRSLPPKRPCLWLSQLLVLTGLFYFCSGITPKSVTKRVKETVMLSCDYNTSTEEL TSLRIYWQKDSKNVLAILPGKVQVPEYKNRTITDMNDNPRIVILALRL5DSGTYTCVIQK |

-continued

SEQUENCES

| SEQ ID | Clone ID Name | Sequence |
|---|---|---|
| | | PVLKGAYKLEHLASVRLMIRADFPVPTINDLGNPSPNIRRLICSTSGGFPRPHLYWLENGE |
| | | ELNATNTTVSQDPGTELYNISSELDFNXTTNNHSIVCLIKYGELSVSQIFPWSKPKQEPPID |
| | | QLPFWVIIPVSGALVLTAVVLYCLACRHVARWKRTRRNEETVGTERLSPIYLGSAQSSG |
| SEQ ID NO:59 | Round 2 CD28BP-8 | MGHTMKWGSLPPKRPCLWLSQLLVLTGLFYFCSGITPKSVTKRVKETVMLSCDYNTSTEEL |
| | | TSLRIYWQKDSKMVLAIL5GKVQVWPEYKNRTITDMNDNPRIVILALRLSDSCTYTCVIQK |
| | | PVLKGAYKLEHLASVRLNIRADFPVPSITDIGHPAPNVKRIRCSASGGFPEPRLAWMEDGE |
| | | ELNAVNTTVDQDLDTELYSVSSELDSNVTNNHSIVCLIKYGELSVSQIPPWSKPKQEPPID |
| | | QLPFWVIIPVSGALVLTAVVLYCLACRHVARWKRTRRNEETVGTERLSPIYLGSAQSSG |
| SEQ ID NO:60 | Round 2 CD28BP-9 | MGHTMKWGSLPSKRPCLWLSQLLVLTGLFYFCSGITPKSVTKRVKETWLSCDYNTSTEEL |
| | | TSLRIYWQKDSKMVLAILPGKVQVWPEYKNRTITDMNDNPRIVILALRLSDSGTYTCVIQK |
| | | PVLKGAYKLEHLASVRLNIRADFPVPTINDLGNPSPNIRRLICSTSGGFPRPHLYWLENGE |
| | | ELNATNTTVSQDPGTELYMISSELDFNVTNNHSIVCLIKYGELSVSQIFPWSKPKQEPPID |
| | | QLPFWVIIPVSGALVLTAVVLYCLACRHXTARWKRTRRNEETVGTERLS5IYLGSAQSSG |
| SEQ ID NO:61 | Round 2 CD28BP-10 | MGHTMKWRSLPPKRPCLWLSQLLVLTGLFYFCSGITPKSVTKRVKETVMLSCDYSTSTEEL |
| | | TSLRIYWQKDSKMVLAILPGKVQVWPEYKNRTITDMNDNPRIVILALRLSDSGTYICVIQK |
| | | PVLKGAYKLEHLTSVRLMIRADFPVPTINDLGNPSPNIRRLICSTSGGFPRPHLYWLENGE |
| | | ELNATNTTLSQDPGTELYMISSELDFNVTNNHSIVCLIKYGELSVSQIFPWSK5KQEPPID |
| | | QLPFWVIIPVSGALXTLTAVVLYCLACRNVARWKRTRBNEETVGTERLSPIYLGSAQSSG |
| SEQ ID NO:62 | Round 2 CD28BP-11 | MGHTMKWGSLPPKRPCLWLSQLLVLTGLFYFCSGITPKSVTKRVKETVMLSCDYNASTEEL |
| | | TSLRIYWQKDSKMVLAILPGKVQVPEYKNRTITDMNDNPRIVILALRLSDKGTYTCVVQK |
| | | NENGSFRREHLTSVTLSIRADFPVPSITDIGHPAPNVKRIRCSASGGFPEPRLAWNEDGEE |
| | | LNAVNTTVDQDLDTELYSVSSELDFNVTNNHSIVCLIKYGELSVSQIFPWSK5KQEPPIDQ |
| | | LPFWVIIPVSGALVLTAWLYCLACRHVARWKRTRRNEETVGTERLSPIYLGSAQSSG |
| SEQ ID NO:63 | Round 2 CD28B5-12 | MGHTMKWGSLPPKRPCLWLSQLLVLTGLFYFCSGITPKSVTKRVKETVMLSCDYSTSTEEL |
| | | TSLRIYWQKDSKMVLAILPGKVQVWPEYKNRTITDMNDNPRIVILALRLSDSGTYTCVIQK |
| | | PVLKGAYKLEHLASVRLNIRADFPVPTINDLGNPSPNIRRLICSTSGGFPRPHLYWLENGE |
| | | ELNATNTTVSQD5GTELYNISSELDFNVTNNHSIVCLIKYGELSVSQIFPWSKPKQEPFID |
| | | QLPFWVIIPVSGALVLTAVVLYCLACRHVARWKRTRRNEETVGTERLSPIYLGSAQSSQ |
| SEQ ID NO:64 | Round 2 CD28BP-13 | MGHTMKWGSLFPKRPCLWLSQLLVLTGLFYFCSGITPKSVTKRVKETVMLSCDYSTSTEEL |
| | | TSLRIYWQKDSKMVLAILPGKVQVWPEYKNRTITDMNDNPRIVILALRLSDSGTYTCVIQK |
| | | PVLKGAYKLEHLASVRLMIEADFPVPTINDLGNPSPNIRRLICSTSGGFPEPRLAWMEDGE |
| | | ELNAVNTTVDQDLDTELYSVSSELDFNVTNNHSIVCLIKYGELSVSQIFPWSKPKQEPPID |
| | | QLPFWVIIPVSGALVLTAWLYCLACRHVARWKRTRRNEETVGTERLSPIYLGSAQSSC |
| SEQ ID NO:65 | Round 2 CD28BP-14 | MGHTLRPGTPLPRCLHLKLCLLLALAGLHFSSGISQVTKSVKEMAALSCDYNISIDELARM |
| | | RIYWQKDQQMVLSIISGQVEVW5EYKNRTITDMNDNPRIVILALRLSDSGTYTCVIQKPVL |
| | | KGAYKLEHLASVRLNIRADFPVPTINDLGNPSPNIRRLICSTSGCFPRPHLYWLENGEELN |

-continued

SEQUENCES

| SEQ ID | Clone ID Name | Sequence |
|---|---|---|
| | | ATNTTVSQDPGTELYMISSELDFNVTNNHSIVCLIKYGELSVSQIFPWSKPKQEPPIDQLP |
| | | FWVIIPVSGALVLTAVVLYCLACRHVARWKRTRRNEETVGTERLSPIYLGSAQSSG |
| SEQ ID NO:66 | Round 2 CD28BP-15 | MGHTMKWGSLPPKRPCLWLSQLLVLTGLFYFCSGITPKSVTKRVKETVMLSCDYNTSTEEL TSLRIYWQKDSKMVLAILPGKVQVWPEYKNRTITDMNDNPRIVILALRPSDSGTYTCVIQK PVLKGAYKLEHLASVRLMIRADFPVPTINDLGNPSPNIRRILICSTSGGFPRPHLYWLENGE ELNATNTTVSQDPGTELYMISSELDFNVTNNHSIVCLIKYGELSVSQTFPWSKPKQEPPID QLPFWVIIPVSGALVLTAVVLYCLACRHVARWKRTRRNEETVGTERLSPIYLGSAQSSG |
| SEQ ID NO:67 | Round 2 CD28BP-16 | MGHTMKWGSLPPKRPCLWLSQLLVLTGLFYFCSGITPKSVTKRVKETVMLSCDYNTSTEEL TSLRIYWQKDSKMVLAILPGKVQVWPEYKNRTITDMNDNPRIVILALRPSDSGTYTCVIQK PVLKGAYKLEHLTSVRLMIPADFPVPTINDLGNPSPNIRRLICSTSGGFPRPHLYWLENGE ELNATNTTVSQDPGTELYMISSELDFNVTNNHSIVCLIKYGELSVSQIFPWSKPKQEPPID QLPFWVIIPVSGALVLAAVVLYCLACRHVARWKRTRRNEETVGTERLSPIYLGSAQSSG |
| SEQ ID NO:68 | Round 2 CD28BP-17 | MGHTMKWGSLPPKRPCLWLSQLLVLTGLFYFCSGITPKSVTKRVKETVMLSCDYSTSTEEL TSLRIYWQKDSKMVLAILPGKVQVWPEYKNRTFPDIINNLSLMILALRLSDKGTYTCVVQK NENGSFRREHLTSVTLSIRADFPVPSITDIGHPAPNVKRIRCSASGDFPEPRLAWMEDGEE LNAVNTTVDQDLDTELYSVSSELDFNVTNNHSIVCLIKYGELSVSQIFPWSKPKQEPPIDQ LPFWVIIPVSGALVLTVVVLYCLACRHVARWKRTRRNEETVGTERLSPIYLGSAQSSG |
| SEQ ID NO:69 | Round 1 CTLA4BP-5 | MGHTRRQGISPSKCPYLKFFQLLVLAGLSHFCSGVIHVTKEVKEVATLSCGHNVSVEELAQ TRIHWQKEKKNVLTMMSGDMNIWPEYKNRTIFDITNNLSIVILALRPSDEGTYECVVLKYE KDAFKREHLAEVTLSVKADFPTPSISDFEIPPSNIRRIICSTSGGFPEPHLSWLENGEELN AINTTVSQDFGTELYTVSSKLDFNMTTNHSFMCLIKYGHLRVNQTFNWNTPKQEHFPDNLL PSWAITILISVNGIFVICCLTYCFAPRCRERRRERLRRESVRPV |
| SEQ ID NO:70 | Round 1 CTLA4BP-7 | MGYTRRQGTSPSKCPYLKEFQLLVLAGLSHLCSGVIHVTNEVKEVATLSCGHNVSGEELAQ TRIYWQKEKKMVLTMMYCDMNIWPEYKNRTIFDITNNLSIVILALRPSDEGTYECVVLKYE KDAFKREHLAEVMLSVKADFPTPSITDFEIPPSNIRRIICLTSGGFPEPRLAWNKDCEELN AISTTVSQDPGTELYAVSSKLDFNMTTNHSFMCLIKYGHLRVNQTFSWNTPKQEHEPDNLL PSWAITLISVNGIFVICCLTYCFAPRCRERRENERLRRESVRPV |
| SEQ ID NO:71 | Round 1 CTLA4BP-11 | MSHTRRQGTSPSKCPYLKFFQLLVLASLSHFCSGVIHMTKEVKEVATLSCGHNVSVEELAQ TRIYWQKEKKMVLTMMSGDNNIWPEYKNRTIFDITNNLSIVILALRPSDEGTYECVVLKYE KDAFKREHLAEVNLSVKADFPTPSITDFEIPPSNIRRIICSTSGGFPEPHLFWLENGEELN AINTTVSQDPETELYAVSSKLDFNMTTNHSFMCLIKYGHLRVNQTFNWNTTKQEHFPDNLL PSWAITLISVNGIFVICCLTRCFAPRCRERRRNERLRRESVHPV |
| SEQ ID NO:72 | Round 1 CTLA4BP-13 | MGHTRRQGISPSKCPYLKFFQLLVLACLSHFCSGVIHVTKEVKEVATLSCGHNVSVEELAQ TRIYWQKEKKNVLTMMSGDMNIWPEYKNRTIFDITNNLSIVILALRPSDEGTYECVVLKYE KDAFKREHLAEVTLSVKADFPTPSISDFEIPTSNIRRICSTSGGFPEPHLFGLENGEEIN AINTTASQDPETELYTVSSKLDFNNTPNRSFVCLIKYGHLRVNQTFNWNTPKQEHFPDNLL PSWAITLISANGIFVICCLTYCFAPRCRERKSNERLRRESVRPV |

| SEQ ID | Clone ID Name | Sequence |
|---|---|---|
| SEQ ID NO:73 | Round 1 CTLA4BP-27 | MSHTRRQGISPSKCPYLNFFQLLVLASLSHFCSGVIHVTKEVKEVATLSCGLNVSVEELAQ TRIYWQKEKKMVLTMMSGDMNIWPEYKNRTIFDITNNLSIVILALRPSDEGTYECVVLKYE KDAFKREHLAEVMLSVKADFPTPSISDFEIPPSNIRRIICSTSGGFPEPHLSWLENGEELN AINTTVSQDPETELYTVSSKLDENMTANHSFVCLIKYGHLRVNQTFNWNTPKQEHFPDNLL PSWAITLISVNGIFVICCLTYCFAPRCRERRRNETLRRESVRPV |
| SEQ ID NO:74 | Round 2 CTLA4BP-5x2-10C | MGHTRRQGISPPKCPYLNFFQLLVLACLSHFCSGVIHVTKEVKEVATLSCGHNVSVEELAQ TRIHWQKEKKMVLTMMSGDMNIWPEYKNRTIFDITNNLSIVILALRPSDEGTYECVVLKYE KDAFKREHLAEVMLSVKADFPTPSITDFEIPPSNIRRIICSTSGGFPEPHLSWLENGEELN AINTTVSQDPETELYTVSSKLDFNMTANHSFVCLIKYGHLRVNQTFNWNTPKQEHFPDNLL PSWAITLISVNGIFVICCLTYCEAPRCRERRNETLRRESVRPV |
| SEQ ID NO:75 | Round 2 CTLA4BP-5x2-11d | MSHTRRQGISPSKCPYLKFFQLLVLACLSHFCSGVIHVTKEVKEVATLSCGHNVSVEELAQ TRIHWQKEKKMVLTMMSGDMNIWPEYKNRTIFDITNNLSIVILALRPSDEGTYECVVLKYE KDAFKREHLAEVMLSVKADFPTPSITDFEIPPSNIRRIICSTSGGFPEPHLPWLENGEELN AINTTVSQDPETELYTVSSKLDFNNTTDRSFVCLIKYGHLRVNQTFNWNTPKQEHFPDNLL PSWAITLISANGIFVICCLTYCFAPRCRERKSNETLRRESVRPV |
| SEQ ID NO:76 | Round 2 CTLA4BP-5x2-12F | MSHTRRQGISPSKCPYLKFFQLLVLASLSHFCSGVIHVTKEVKEVATLSCGHNVSVEELAQ TRIHWQKEKKNVLTNMSGDMNIWPEYKNRTIFDITNNLSIVILALRPSDEGTYECVVLKYE KDAFKREHLAEVTLSVKADFPTPSITDFEIPPSNIKRIICSTSGGFPEPHLSWLENGEELN AINTTVSQDPETELYTVSSKLDFNMTTNHSFMCLIKYGELRVNQTFNWNTPKQEHFPDNFL PSWAITLISANGIFVICCLTYCFAPRCRERRRNETLRRESVRPV |
| SEQ ID NO:77 | Round 2 CTLA4BP-5x2-2g | MGHTRRQGTSPSKCPYLKFFQLLVLACLSHFCSGVIHVTKEVKEVATLSCGHNVSVEELAQ TRIHWQKEKKMVLTMMSGDMNTWPEYKNRTIFDITNNLSIVILALRPSDEGTYECVVLKYE KDAFKREHLAEVMLSVKADFPTPSITDFEIPTSNIRRIICSTSGGFPEPHLSWLENGEELN AINTTVSQDPETELYTVSSKLDFNMTTNHSFMCLIKYGHLRVNQTFNWNTPKQEHFPDNLL PSWAITLISVNGIFVICCLTYRFAPRCRERKSNERLRRESVRPV |
| SEQ ID NO:78 | Round 2 CTLA4BP-5x2-3c | MGYTRRQGTSPSKCPYLKFFQLLVLACLSHFCSGVIHVTREVKEVATLSCGHNVSVEELAQ TRTHWQKEKKNVLTMMSGDNNTWPEYKNRTTFDITNNLSIVILALRPSDEGTYECVVLKYE KDAFKREHLAEVMLSVKADFPTPSISDFEIFTSNIRRIICSTSGGFPEPHLSWLENGEELN AINTTVSQDPETGLYTVSSKLDFNMTTNHSFMCLIKYGHLRVNQTFNWNTFKQEHFPDNLL PSWAITLISVNGIEVICCLTYCFAPRCRERRRNERLRRESVCPV |
| SEQ ID NO:79 | Round 2 CTLA4BP-5x2-4C | MSHTRRQGTSPSKCPYLKFFQLLVLASLSHFCSGVIHVTKEVKEVATLSCGLNVSVEELAQ TRIYWQKEKKMVLTMMSGDNNIWPEYKNRTIFDITNNLSIVILALRPSDEGTYECVVLEYE KDAFKRENLAEVMLSVKADFPTPSISDEEIPPSNIRRIICSTSGGEPEPRLSWLENGEELN GINTTVSQDPETELYTVSSKLDFNMTTNRSFVCLIKYGHLRVNQTFNWNTFKQEHFFDNLL PSWAITLISVNGIFVICCLTYCFAPRCRERRRNERLRRESVHPV |

| SEQ ID | Clone ID Name | Sequence |
|---|---|---|
| SEQ ID NO:80 | Round 2 CTLA4BP- 5x2-7b | MSHTRRQGISPSKCPYLNFFRLLVLASLSHFCSGVIHVTKEVKEVATLSCGHNVSVEELAQ TRIHWQKEKKMVLTMMSGDMNIWPEYKNRTIFDITNNLSIVILALRPSDEGTYECVVLKYE KDAFKRENLAEVTLSVKAGFPTPSITDEEIFPSNIRRIICSTSGGFPEPRLSWLENGEELN AINTTVSQDPGTELYTVSSKLDFNMTANHSFVCLIKYGHLRVNQTFNWNTPKQEEFPDNLL PSWAITLISANGIFVICCLTYCFAPRCRERRRNERLRRESVRPV |
| SEQ ID NO:81 | Round 2 CTLA4BP- 5x2-8c | MSHTRRQGTSPSKCPYLKFFQLLVLASLSHFCSGVIHMTKEVKEVATLSCGHNVSVEELAQ TRIYWQKEKKMVLTMMSGDMNIWPEYKNRTIFDITNNLSIVILALRPSDEGTYEGVVLKYE KDAFKQEHLAEVMLSVKADFPTPSITDFEIFPSNIRRIICSTSGCFPEPHLEWLENGEELN AINTTVSQDPETELYAVSSKLDFNNTTNNSFVCLIKYGHLRVNQTFNWNTPKQEHFPDNLL PSWAITLISANGIFVICCLTYCFAPRCRERRRNERLRRESVHPV |
| SEQ ID NO:82 | Round 2 CTLA4BP- 5x3-10e | MGYTRRQGISPSKCPYLKPFQLLVLACLSHPCSGVIHVTKEVKEVATLSCGHNVSVEELAQ TRIYWQKEKKMVLTMMSGDMNIWPEYKNRTIFDITNNLSIVILALRPSDEGTYECVVLEYE KDAFKREHLAEVTLSVKADFPTPSISDFEIPPSNIRRIICSTSGGFPEPHLFWLENGEELN AINTTVSQDPETELYAVSSKLDFNMTTNHSFMCLIKYGHLRVNQTFNWNTPKQEHFPDNLL PSWAITLISANGIFVICCLTYCFAPRCRERKSNERLRRESVHPV |
| SEQ ID NO:83 | Round 2 CTLA4BP- 5x3-11b | MSHTRRQGISPSKCPYLKFFQLLVLACLSHFCSGVIHVTKEVKEVATLSCGRNVSVEELAQ TRIYWQKEKKNVLTMMSGDMNIWPEYKNRTIFDITNNLSIVILALRSSDEGTYECVVLKYE KDAEKREHLAEVTLSVKADFPTPSTTDFEIPPSNIRRIICSTSGGFFEPHLSWLENGEELN ATSTTVSQDPETELYTVSSKLDFNNTTNRSFVCLIKYGHLRVNQTFNWNTPKQEHFFDNLL PSWAITLISVNGIFVICCLTYCFAPRCRERRSNERLRRESVRPV |
| SEQ ID NO:84 | Round 2 CTLA4BP- 5x3-6f | MGHTRRQGISPSKCPYLNFFQLLVLAGLSHPCSGVINVTKEVKEVATLSCGNNVSVEELAQ TRIYWQKGKKMVLTMMSGDMNIWPEYKNRTIFDITNNLSIVILALRPSDEGTYECVVLEYE KDAFKRENLAEVNLSVKADFPTPSISDPEIPTSNIRRIICSTSGGFPEPHLSWLENGEELN AINTTASQDPETELYTVSSKLDFNNTTNHSFMCLIKYGHLRVNQTFNWNTPKQENFPDNLL PSWATTLISANGIFVICCLAYCFAPGCRERKSNERLRRESVRPV |
| SEQ ID NO:85 | Round 2 CTLA4BP- 5x4-11d | MGHTRRQGISPSKCPYLKFEQLLVLACLSNLCSGVIHVTKEVKEVATLSCGLNVSVEELAQ TRIRWQKEKKKVLTNNSGDNKIWPEYKNRTIFDITNNLSIVILALRPSDEGTYECVVLKYD KDAFKRENLAEVTLSVKADFPTPSISDFEIPPSNIRRIICSTSGGFPEPHLSWLENGEELN AINTTVSQDPETELYTVSSKLDFNMTANESFVCLIKYGHLRVNQTFNWNTPKQEHFPDNLL PSWAITLISVNGIFVICCLTYREAPRCRERKSNERLRRESVRPV |
| SEQ ID NO:86 | Round 2 CTLA4BP- 5x4-12C | MGHTRRQGTSPSKCPYLKFFQLLVLAGLSNFCSGVIHVTKEVKEVATLSCGHNVSVEELAQ TRIHWQKEKKMVLTNNSGDMNIWPEYKNRTIFDITNNLSIVILALRPSDEGTYECVVLKYE KDAFKREHLAEVMLSVKADFPTPSISDEEIPPSNIRRIICSTSGGFPEPHLFWLENGEELN AINTTVSQDPETELYTVSSKLDFNNTTNHSFNCLIKYGHLRVNQTFNWNTFKQEHFPDNLL PSWAITLISANGIFVICCLTYRFAPRCRERKSNETLRRESVRPV |

-continued

SEQUENCES

| SEQ ID | Clone ID Name | Sequence |
|---|---|---|
| SEQ ID NO:87 | Round 2 CTLA4BP- 5x4-1f | MGHTRRQGTSPSKCPYLKFEQLLVMACLSHPCSGVIHVTKEVKEVATLSCGHNVSVEELAQ<br>TRIHWQKEKKMVLTNMSGDMNTWPEYKNRTIFDITNNLSIVTLALRPSDEGTYECVVLKYE<br>KDAFKREHLAEVNLSVKADFPTPSISDPEIPTSNIRRIICSTSGGFPEPHLFWLENGEELN<br>AINTTVSQDPETELYTVSSKLDFNMTTNHSFNCLIKYGHLRVNQTFNWNTPKQEHFPDNLL<br>PSWAITLISVNGIFVICCLTYCFAPRCRERRRNERLRRESVCPV |
| SEQ ID NO:88 | Round 2 CTLA4BP- 5x5-2e | MGHTRRQGTSPSKCPYLKFFQLLVLACLSHFCSGVIHVTKEVKEVATLSCGLNVSVEELAQ<br>TRTHWQKEKKMVLTMMSGDNNIWPEYKNRTIFDITNNLSIVILALRPSDEGTYECVVLKYE<br>KDAFKREHLAEVMLSVKADFPTPSTSDFETPPSNIRRTTCSTSGGFPEPHLSWLENGEELN<br>AINTTVSQDPETELYAVSSKLDFNMTTNHSFMCLIKYGNLRVNQTFNWNTFKQEICPDNLL<br>PSWAITLISVNGFVTCCLTYCFAPRCRERRRNETLRRESVRPV |
| SEQ ID NO:89 | Round 2 CTLA4BP- 5x5-6e | MGHTRRQGISPSKCPYLKFFQLLVLAGLPHLCSGVIHVTKEVKEVATLSCGHNVSVEELAQ<br>TRIHWQKEKKNVLTMKSGDMNIWPEYKNRTIFDTTNNLSIVTLALRPSDEGTYECVVLKYE<br>KDAFKREHLAEVMLSVKADFPTPSITDFEIPPSNIRRIICSTSGGFPEPHLSWLENGEELN<br>AISTTVSQDPETELYTVSSKLDFNMTTNHSFMCLIKYGHLRVNQTFNWNTTKQEHFPDNLL<br>PSWAITLISANGIFVICCLTHCFAPRCRERKRNERLRRESVRPV |
| SEQ ID NO:90 | Round 2 CTLA4BP- 5x6-9d | MSHTRRQGTSPSKCPYLKPFQLLVLAGLSHLCSGVIHVTKEVKEVATLSCGHNVSVEELAQ<br>TRIHWQKEKKMVLTMMSGDMNIWPEYKNRTIFDITNNLSIVILALRPSDEGTYECVVLKYE<br>KDAEKREHLAEVMLSVKADFPTPSISDFEIPTSNIRRIICSTSGGFPEPHLSWLENGEELN<br>AINTTVSQDPETELYTVSSKLDFNMTANHSFVCLIKYGHLRVNQTFNWNTPKQEHFPDNLL<br>PSWAITLISVNGIFVICCLTYCFAPRCRERRRNERLRRESVRPV |
| SEQ ID NO:91 | Round 2 CTLA4BP- 5x8-1f | MGHTRRQGISPSKCPYLNFFQLLVLACLSHFCSGVIHVTKEVKEVATLSCGHNWSVEELAQ<br>TRIHWQKEKKNVLTMMSGDMNIWPEYKNRTIFDITNNLSIVILALRPSDEGTYECVVLKYE<br>KDAFKREHLAEVMLSVKADFPTPSITDFEIPPSNIRRIICSASGGFPEPHLFWLENGEELN<br>AINTTVSQDPETELYAVSSKLDFNMTTNHSFMCLIRYGHLRVNQTFNWNTPKQEHFPDNLL<br>PSWAITLISVNGIFVICCLTYCFAPRCRERKSNERLRRESVRPV |
| SEQ ID NO:92 | Round 2 CTLA4BP- 5x9-12C | MGHTRRQGTSPSKCPYLNFFQLLVLACLSHFCSGVIHVTKEKEVATLSCGHNVSVEELAQ<br>TRIHWQKEKKMVLTMMSGDMNIWPEYKNRTIFDITNNLSIVILALRPSDEGTYECVVLKYE<br>KDAFKREHLAEVMLSVKADFPTFSITDFEIPPSNIRRIICSTSGGFPEPHLSWLENGEELN<br>AINTTASQDPETELYTVSSKLDFNMTTNHSFMCLIKYGHLRVNQTFNWNTPKQEHFPDNLL<br>PSWAITLISVNGIFVICCLTYCFAPRCRERKSNERLRRESVRPV |
| SEQ ID NO:93 | Baboon B7-1 | MGHTRRQGISPSKCPYLKFFQLLVLACLSHFCSGVIHVTKEVKEVATLSCGHNVSVEELAQ<br>TRIYWQKEKKMVLTMMSGDMNIWPEYKNRTIFDITNNLSIVILALRPSDEGTYECVVLKYE<br>KDAFKREHLAEVMLSVKADEPTPSITDFEIPPSNIRRIICSTSGGFPEPHLFWLENGEELN<br>AINTTVSQDPGTELYTVSSKLDFNMTTNNSFVCLIKYGNLRVNQTFNWNTPKQENFPDNLL<br>PSWAITLISVNGIFVICCLTYCFAPRCRERRRNETLRRESVRPV |
| SEQ ID NO:94 | Orangutan B7-1 | MGHTRRQGTSPSKCPYLNFFQLLVLASLSHECSGVIHVTKEVKEVATLSCGHNVSVEELAQ<br>TRIYWQKEKKMVLTMMSGDMNIWPEYKNRTIFDTNNLSIVILALRPSDEGTYECVVLKYE |

-continued

SEQUENCES

| SEQ ID | Clone ID Name | Sequence |
|---|---|---|
| | | KDAFKREHLAEVTLSVKADFPTPSISDFEIPTSNIRRMICSTSGGFPEPNLSWLENGEELN |
| | | AISTTVSQDPETELYAVSSKLDFNNTTNHSFMCLIKYGHLRVNQTFNWNTPKQEHFPDNLL |
| | | PSWAITLTSVNGIEVICCLTYCFAPRCRERRSNERLRRESVRPV |
| SEQ ID NO:95 | Round 2 CD28A12-5 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGMACAGTAATGCTATCCTGTGATTACCAACACATCCACTGAAGAACTG |
| | | ACAAGCCTTCGCATCTATTGGCGAAAGGATAGTAAAATGNTGCTGCCCATCCTGCCTGGAA |
| | | AAGTGCAGGTGTGGCCTGAGTACAAGAACCGTACCATCACTGACATGAACGATAACCTCCG |
| | | TATTGTGATCCTGGCTCTGCGCCTGTCGGACAGTGGCACCTACACCTGTGTTATTCAGAAG |
| | | CCTGATTTGAAAGGGGCTTATAAACTGGAGCACCTGACTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTTGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTGA |
| SEQ ID NO:96 | Round 2 CD28A4-5* | ATGGGTCACACAATGAAGTGGGGATCACTACCACCCAAGTGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGGCTTATAAACTGGAGCACCTGACTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACACTGTCCCAAGATCCTGAAACCAAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACCGAAAGGCTGTCCCCTATCTACTTAGGCTCTGCGCAATCCTCGGGCTGA |
| SEQ ID NO:97 | Round 2 CD28A4-9 | ATGGGTCACACAATGAAGTGGGGATCACTACCACCCAAGCGCCCATGCCTCTGCCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAAAACTG |
| | | ACAAGCCTTCGGATCTATTGGCAAAAGCATAGTAAAATGGTGCTGGCCATCCTGCCTGGAA |

-continued

SEQUENCES

| SEQ ID | Clone ID Name | Sequence |
|---|---|---|
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGGCTTATAAACTGGAGCACCTGACTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGAAACCAAGCTCTACATGATTA |
| | | GCAGTGAACTGGATTTCAATGTGACAAATAACCACAGCATCGTGTGTCTCATCAAATACGG |
| | | GGAGCTCTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCCGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCTCGGGCTGAGGTA |
| | | CCAAGCTTAAGTTNA |
| SEQ ID NO:98 | Round 2 CD28A6-9 | ATCGGTCACACAATGAAGTGGGGATCACTACCACCCAAGCGCCCATGCCTCTGCCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATCCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGGCTTATAAACTGGAGCACCTGGCTTCCGTGAGGTTAATGATCAGAG |
| | | CTGACTTCCCTGTCCCTACCATAAATCATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | CAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTTGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTGA |
| SEQ ID NO:99 | Round 2 CD28A6-1 | ATGGGTCACACAATGAAGTGGGGATCACTACCACCCAAGCGCCCATGCCTCTGGCTCCCTC |
| | | AGCTCTTGGTGCTCACTCGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTCCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGAAACCAAGCTCTACATGATTA |

| SEQ ID | Clone ID Name | Sequence |
|---|---|---|
| | | GCAGTGAACTGGATTTCAATGTGACAAATAACCACAGCATTGTGTGTCTCATCAAATACGG |
| | | GCAGCTGTCGGTGTCACAGATCTTCCCTTGGAGCAAACCCAAGCAGGAGCCTCCCATTGAT |
| | | CAGCTTCCATTCCGGGTCATTATCCCAGTAAGTGGTGCTTTGGTCCTCACTGCGATAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTGA |
| SEQ ID NO:100 | Round 2 CD28A8-4 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAACGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACACTGGCACCTACACCTGTGTTATTCAGAAG |
| | | CCTGTTTTGAAAGGGGCTTATAAACTGGAGCACCTGACTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTAG |
| SEQ ID NO:101 | Round 2 CD28A8-6 | ATGGGTCACACAATGAAGTGGGGATCACTACCACCCAAGCGCCCATGCCTCTGGCTCTCCC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCCATCCTGTGATTACAGCACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGCGTGGTTCAGAAG |
| | | AATGAGAACGGGTCTTTCAGACGGGAGCACCTGACCTCCGTGACACTGTCCATCAGAGCTG |
| | | ACTTCCCTGTCCCTAGCATAACTGACATTGGACATCCCGCCCCTAATGTGAAAAGGATAAG |
| | | ATGCTCCGCCTCTGGAGGTTTTCCAGAGCCTCGCCTCCCCTGGATGGAAGATGGAGAAGAA |
| | | CTAAACGCCGTCAACACAACGGTTGACCAGGATTTGGACACGGAGCTCTACAGCGTCAGCA |
| | | GTGAGCTGGATTTCAATGTGACAAATAACCACAGCATCGTGTGTCTCATCAAATACGGGGA |
| | | GCTGTCGGTGTCACAGATCTTCCCTTGGAGCAAACCCAAGCAGGAGCCTCCCATTGATCAG |
| | | CTTCCATTCTGGGTCATTATCCCAGTAAGTGGTGCTTTGGTGCTCACTGCGGTAGTTCTCT |
| | | ACTGCCTGGCCTGCAGACATGTTGCGAGGTGGAAAAGAACAAGAAGGAATGAAGAGACAGT |
| | | GGGAACTGAAAGGCTCTCCCCTATCTACTTAGGCTCTGCGCAATCCTCGGGCTGA |
| SEQ ID NO:102 | Round 2 CD28B2-8 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACGCCAAAGAGTGTGAC |

| SEQ ID | Clone ID Name | Sequence |
|---|---|---|
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAAGGGCACCTACACCTGTGTTATTCAGAAG |
| | | CCTGTTTTGAAAGGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACGAGAAGGAATGAAGAGAC |
| | | AGTGGGAACTGAAAGGCTGTCCCCTATCTACTTAGGCTCTGCGCAATCCTCGGGCTGA |
| SEQ ID NO:103 | Round 2 CD28B4-3 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCATGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGGCTTATAAACTGGAGCACCTGACTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGACAA |
| | | GAATTAAATGCTACCAACACAACACTGTCCCAAGATCCTGAAACCAAGCTCTACATGATTA |
| | | GCAGTGAACTGGATTTCAACATGACAAGCAATCACAGCTTCTTGTGTCTTGTCAAGTATGG |
| | | AGACTTAACAGTGTCACAGACCTTCTACTGGCAAGAATCCAAACCAACCCCTTCTGCTAAT |
| | | CAGCACCTGACCTGGACCATTATTATCCCAGTCTCAGCATTTGGGATTTCTGTGATCATTG |
| | | CAGTTATACTAACATGCCTGACCTGCAGAATGCTGCAATACGCAGACAGAGAAAGGGAGAA |
| | | TGAAGTGGAAATGCAAAGTTGCTCTCAGTCTCCATAG |
| SEQ ID NO:104 | Round 2 CD28B6-3 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGATTTGAAAGGGGCTTATAAACTGGAGCACCTGACTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTCGAAAATGGAGAA |

| SEQ ID | Clone ID Name | Sequence |
|---|---|---|
| | | GAATTAAATGCTACCAACACAACACTGTCCCAAGATCCTGAAACCAAGCTCTACATGATTA |
| | | GCAGTGAACTGGATTTCAACATGACAAGCAATCACAGCTTCTTGTGTCTTGTCAAGTATGG |
| | | AGACTTAACAGTGTCACAGACCTTCTACTGGCAAGAATCCAAACCAACCCCTTCTGCTAAT |
| | | CAGCACCTGACCTGGACCATTATTATCCCAGTCTCAGCATTTGGGATTTCTGTGATCATTG |
| | | CAGTTATACTAACATGCCTGACCTGCAGAAATGCTGCAATACGCAGACAGAGAAGGGAGAA |
| | | TGAAGTGAAAATGCAAAGTTGCTCTCAGTCTCCATGAG |
| SEQ ID NO:105 | Round 2 CD28B6-6 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAGCACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAAGGGCACCTACACCTGTGTTATTCAGAAG |
| | | CCTGTTTTGAAAGGGCTTATAAACTGGAGCACCTGACCTCCGTGACACTGTCCATCAGAG |
| | | CTGACTTCCCTGTCCCTAGCATAACTGACATTGGACATCCCGCCCCTAATGTGAAAAGGAT |
| | | AAGATGCTCCGCCTCTGGAGGTTTTCCAGAGCCTCGCCTCGCCTGGATGGAAGATGGAGAA |
| | | GAACTAAACGCCGTCAACACGACGGTTGACCAGGATTTGGACACGGAGCTCTACAGCGTCA |
| | | GCAGTGAACTGGATTTCAATGCGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTGTCCCAGTAAGTGGTGCTTTGGTGCTCACTGCGGTAGTTC |
| | | TCTACTGCCTGGCCTGCAGACATGTTGCGAGGTGA |
| SEQ ID NO:106 | Round 2 CD28B8-5* | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATCCTATCCTGTGATTACAGCACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGCTTATAAACTGGAGCACCTGACTTCCGTGAGGTTATGATCAGAAG |
| | | CTGACTTCCCTGTCCCTACCAATAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACACTGTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCACAATCCTCGGGCTGA |
| SEQ ID NO:107 | Round 2 CD28C11-5 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |

-continued

SEQUENCES

| SEQ ID | Clone ID Name | Sequence |
|---|---|---|
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGGCTTATAAACTGGAGCACCTGACTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGCGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTAG |
| SEQ ID NO:108 | Round 2 CD28C6-1 | ATGGGTCACACAATGAAGTCGGGATCACTACCACCCAAGCGCCCATGCCTCTGGCTCTCTC |
| | | ACCTCTTGGTGCTCACTGGTCTTTTTACTTCTGTTCACGCATCACCCCAAAGAGTGTGAC |
| | | CAAAGAGTGAAAGAAACAGTAATGCTATCCTGTGATTACAGCACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGCGCTTATAAACTGGAGCACCTGGCTTCCGTGACGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |
| | | CGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGGTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTGA |
| SEQ ID No: 109 | Round 2 CD28C7-3 | ATGGGTCACACAATGAAGTGGGGATCACTACCACCCAAGCGCCCATGCCTCTGGCTCTCTC |
| | | AGCTCTTGGTGCTCACTGGTCTTTTTACTTCTCTTCAGGCATCACCCCAAAGAGTGTGAC |
| | | CAAAGAGTGAAAGAAACAGTAATGCTATCCTGTGATTACAGCACATCCACTGAAGAACTG |
| | | ACAAGCCTTCGGATCTATTGGCAAAAGGATAGTAAAATGGTGCTGGCCATCCTGCCTGGAA |
| | | AAGTCCACGTGTGGCCTGAGTACAACAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGATTTGAAAGGGGCTTATAAACTGGAGCACCTGACTTCCGTGAGGTTAATGATCAGAG |
| | | CTGACTTCCCTGTCCCTAGCATAACTGACATTGGACATCCCGCCCCTAATGTGAAAAGGAT |
| | | AAGATGCTCCGCCTCTGGAGATTTTCCAGAGCCTCGCCTCGCCTGGATGGAAGATGGAGAA |

-continued

SEQUENCES

| SEQ ID | Clone ID Name | Sequence |
|---|---|---|
| | | GAACTAAACGCCGTCAACACGACGGTTGACCAGGATTTGGACACGGAGCTCTACAGCGTCA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTCCGAGGTGGAAAAGAACAAGAAGGAATGAACAGAC |
| | | AGTCGGAACTGAAAGGCTGTCCCCTATCTACTTAGGCTCTGCGCAATCCTCGGGCTGA |
| SEQ ID NO:110 | Round 2 CD28C8-6 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCACGTGTGCCCTGAGTACAAGAACCCCACCATCACTGACATGAACGATAACCCCCG |
| | | TATTGTGATCCTGGCTCTGCGCCTGTCGGACAGTGGCACCTACACCTGTCTTATTCAGAAG |
| | | CCTGTTTTGAAAGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGGTTTCAATGTGACAAATAACCACAGCATCGTGTGTCTCATCAAATACGG |
| | | GGAGCTGTCGGTGTCACAGATCTTCCCTTGGACCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTGAG |
| SEQ ID NO:111 | Round 2 CD28C9-5* | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTCTTCAGGCATCACCCCAAAGAGTGTGAC |
| | | CAAAAGAGTGAAAGAAACAGTAATGCTATCCTGTGATTACAGCACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTCTGTTATTCAGAAG |
| | | CCTGTTTTCAAAGGGCTTATAACTGGAGCACCTCGCTTCTGTGAGGTTAATGATCAGAG |
| | | CTGACTTCCCTGTCCCTACCATAAATGATCTTGGAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | CCAGTGAACTGGATTTCAATGTGACAATAACCACAGCATCGTGTGTCTCATCAAATACGG |
| | | GGAGCTGTCGGTGTCACAGATCTTCCCTTGGAGCAAACCCAAGCAGGACCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTNGAAAAGAACAAGAAGGAATGAAGAGAC |
| | | AGTGGGAACTGAAAGGCTGTCCCCTATCTACTTAGGCTCTGCGCAATCCTCGGGCTAG |

| SEQ ID | Clone ID Name | Sequence |
|---|---|---|
| SEQ ID NO:112 | Round 2 CD28C2-4 | ATGGGCCACACGCTGAGGCCGGGAACTCCACTGCCCAGGTGTCTACACCTCAAGCTCTGCC<br>TGCTCTTGGCGCTGGCGGGTCTCCACTTCTCTTCAGGTATCAGCACCAGGTCACCAAGTCGGT<br>GAAAGAAATGGCAGCACTGTCCTGTGATTACAACATTTCTATCGATGAACTGGCGAGAATG<br>CGCATATACTGGCAGAAGGACCAACAGATGGTGCTGAGCATCATCTCTGGGCAAGTGGAGG<br>TGTGGCCTGAGTACAAGAACCGCACCATCACTGACATGAACGATAACCCCCGTATTGTGAT<br>CCTGGCTCTGCGCCTGTCGGACAGTGGCACCTACACCTGTGTTATTCAGAAGCCTGTTTTG<br>AAAGGGGCTTATAAACCGGAGCACCTGGCTTCCGTGAGGTTAATGATCAGAGCTGACTTCC<br>CTGTCCCTACCATAAATGATCTTGGAAATCCATCTCCTAATATCAGAAGGCTAATTTGCTC<br>AACCTCTGGAGGTTTTCCAAGGCCCCAACCTCTACTGGTTGGAAAATGGAGAAGAATTAAAT<br>GCTACCAACACAACACTGTCCCAAGATCCTGAAACCAAGCTCTACATGATTAGCAGTGAAC<br>TGGATTTCAACATGACAAGCAATCACAGCTTCTTGTGTCTTGTCAAGTATGGGACTTAAC<br>AGTGTCACAGACCTTCTACTGGCAAGAATCCAAACCAACCCCTTCTGCTAATCAGCACCTG<br>ACCTGGACCATTATTATCCCAGTCTCAGCATTTGGGATTTCTGTGATCATTGCAGTTATAC<br>TAACATGCCTGACCTGCAGAATGCTGCAATACGCAGACAGAGAAGGGAGAATGAAGTGGA<br>AATCCAAAGTTGCTCTCAGTCTCCATAG |
| SEQ ID NO:113 | Round 2 CD28D2-3 | ATGGGTCACACAATGAAGTGGGGATCACTACCACCCAAGCGCCCATGCCTCTGGCTCTCTC<br>AGCTCTTGGTGCTCACTGGTCTTTTTTACTTCTGTTCAGGCATCACCCCAAAGAGTGTGAC<br>CAAAAGAGTGAAAGAAACAGTAATGCTATCCTGTGATTACAACACATCCACTGAAGAACTG<br>ACAAGCCTTCGGATCTATTGGCAAAAGGATAGTAAAATGGTGCTGGCCATCCTGCCTGGAA<br>AAGTGCAGGTGTGGCCTGAGTACAAGAACCGCACCATCACTGACATGAACGATAACCCCCG<br>TATTGTGATCCAGGCTCTGCGCCTGTCGGACAGTGGCACCTACACCTGTGTTATCCAGAAG<br>CCTGTTTTGAAAGGGGCTTATAAACTGGAGCACCTGGCTTCCGTGAGGTTAATGATCAGAG<br>CTGACTTCCCTGTCCCTACTGATCTTGGAAATCCATCTCCTAATATCAGAAGGCTAATTTG<br>CTCAACCTCTGGAGGTTTTCCAAGGCCCCACCTCTACTGGTTGGAAAATGGAGAAGAATTA<br>AATGCTACCAACACAACAGTTTCCCAAGATCCTGGAACTGAGCTCTACATGATTAGCAGTG<br>AACTGGATTTCAATGTGACAAATAACCACAGCATCGTGTGTCTCATCAAATACGGGGAGCT<br>GTCGGTGTCACAGATCTTCCCTTGGAGCAAACCCAAGCAGGAGCCTCCCATTGATCAGCTT<br>CCATTCTGGGTCATTATCCCAGTAAGTGGTCCTTTGGTGCTCACTGCGGTAGTTCTCTACT<br>GCCTGGCCTGCAGACATGTTGCGAGGTGGAAAAGAACAAGAAGGAATGAAGAGACAGTGGG<br>AACTGAAAGGCTGTCCCCTATCTACTTAGGCTCTGCGCAATCCTCGGGCTGA |
| SEQ ID NO:114 | Round 2 CD28D2-9 | ATGGGTCACACAATGAAGTGGGGATCACTACCACCCAAGCGCCCATGCCTCTGGCTCTCTC<br>AGCTCTTGGTGCTCACTGGTCTTTTTTACTTCTGTTCAGGCATCACCCCAAAGAGTGTGAC<br>CAAAAGAGTGAAAGAAACAGTAATGCTATCCTGTGATTACAACACATCCACTGAAGAACTG<br>ACAAGCCTTCGGATCTATTGGCAAAAGGATAGTAAAATGGTGCTGGCCATCCTGCCTGGAA<br>AAGTGCAGGTGTGGCCTGAGTACAAGAACCGCACCATCACTGACATGAACGATAACCCCCG<br>TATTGTGATCCTGGCTCTGCGCCTGTCGGACAGTGGCACCTACACCTGTGTTATTCAGAAG<br>CCTGTTTTGAAAGGGGCTTATAAACTGGAGCACCTGACTTCCGTGAGGTTAATGATCAGAG |

-continued

SEQUENCES

| SEQ ID | Clone ID Name | Sequence |
|---|---|---|
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACACTGTCCCAAGATCCTGAAACCGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCACGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTGA |
| SEQ ID NO:115 | Round 2 CD28D8-9 | ATGGCTCACACAATGAAGTGGGGATCACTACCACCCAAGCGCCCATGCCTCTGGCTCTCTC |
| | | ACCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAGCACATCCACTGAAGAACTG |
| | | ACAAGCCTTCGGATCTATTGGCAAAAGGATAGTAAAATGGTCCTGGCCATCCTGCCTGGAA |
| | | AAGTGCAGGTGTGGCCTGAGTACAACAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGCTTATAAACTGCAGCACCTGACTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGCTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAACCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAACGCTGTCCCCTATCTACTTAGGCTCTGCGCAATCCTCGGGCTGA |
| SEQ ID NO:116 | Round 2 CD28D11-1 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGCGTGGTTCAGAAG |
| | | AATGAGAACGGGTCTTTCAGACGGGAGCACCTGACCTCCGTGACACTGTCCATCAGAGCTG |
| | | ACTTCCCTGTCCCTAGCATAACTGACATTGGACATCCCGCCCCTAATGTGAAAAGGATAAG |
| | | ATGCTCCGCCTCTGGAGATTTTCCAGAGCCTCCCCTCGCCTGGATGGAAGATGGAGAACAA |
| | | CTAAACGCCGTCAACACGACGGTTCACCAGGATTTGGACACGGAGCTCTACAGCGTCAGCA |
| | | GTGAACTGGATTTCAATGTGACAAATAACCACAGCATCGTCTGTCTCATCAAATACGGGGA |
| | | GCTGTCGGTGTCACAGATCTTCCCTTGGAGCAAACCCAAGCAGGAGCCTCCCATTGATCAG |
| | | CTTCCATTCTGGGTCATTATCCTAGTAAGTGGTGCTTTGGTGCTCACTGCGGTAGTTCTCT |

-continued

| SEQ ID | Clone ID Name | Sequence |
|---|---|---|
| | | ACTGCCTGGCCTGCAGACATGTTGCGAGGTGGAAAAGAACAAGAAGGAATGAAGAGACAGT |
| | | GGGAACTGAAACGCTGTCCCCTATCTACTTAGGCTCTGCGCAATCCTCGGGCTGAG |
| SEQ ID NO:117 | Round 2 CD28D12-5 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAGCACATCCACTGAAGAACTG |
| | | ACAAGCCTTCGGATCTATTGGCAAAAGGATAGTAAAATGGTGCTGGCCATCCTGCCTGGAA |
| | | AAGTCCAGGTGTGGCCTGAGTACAACAACCCCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGGCTTATAAACTGGAGCACCTGGCTTCCGTGAGGTTAATGATCAGAG |
| | | CTGACTTCCCTGTCCCTAGCATAACTGACATTGGACATCCCGCCCCTAATGTGAAAAGGAT |
| | | AAGATGCTCCGCCTCTGGAGATTTTCCAGAGCCTCGCCTCGCCTGGATGGAAGATCGAGAA |
| | | GAACTAAACGCCGTCAACACGACGGTTTTGGACACGGAGCTCTACAGCGTCAGCAGTGAAC |
| | | TGGATTTCAATGTGACAAATAACCACAGCATCGTGTGTCTCATCAAATACGGGGAGCTGTC |
| | | GGTGTCACAGATCTTCCCTTGGAGCAAACCCAAGCAGGAGCCTCCCATTGATCAGCTTCCA |
| | | TTCTGGGTCATTATCCCAGTAAGTGGTGCTTTGGTGCTCACTGCGGTAGTTCTCTACTGCC |
| | | TGGCCTGCAGACATGTTGCGAGGTGGAAAAGAACAAGAAGGAATGAAGAGACAGTGGGAAC |
| | | TGAAAGGCTGTCCCCTATCTACTTAGGCTCTGCGCAACCCTCGGGCTCA |
| SEQ ID NO:118 | Round 2 CD28E10-6 | ATGGGTCACACAATGGAGTGGGGATCACTACCACCCAAGCGCCCATGCCTCTGGCTCTCTC |
| | | AGCTCTTCGTGCTCACTGGTCTTTTTTACTTCTGTTCAGGCATCACCCCAAAGAGTGTGAC |
| | | CAAAAGAGTGAAAGAAACAGTAATGCTATCCTGTCATTACAACACATCCACTGAAGAACTC |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTAGAAAATCGAGAA |
| | | GAATTAAATGCTACCAACACAACACTGTCCCAAGATCCTGAAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTCCCTGGCCTGCAGACATGTTGCGAGGTGGAAAAGAACAAGAAGGAATGAAGACAC |
| | | AGTGGGAACTGAAAGGCTGTCCCCTATCTACTTAGGCTCTGCGCAATCCTCGGGCTGA |
| SEQ ID NO:119 | Round 2 CD28F7-2 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAGCACATCCACTGAAGAACTG |
| | | ACAAGCCTTCGGATCTATTGGCAAAAGGATAGTAAAATGGTGCTGGCCATCCTGCCCGGAA |
| | | AAGTGCAGGTGTGGCCTGAGTACAAGAACCGCACCATCACTGACATGAACGATAACCCCCG |

| SEQ ID | Clone ID Name | Sequence |
|---|---|---|
| | | TATTGTGATCCTGGCTCTGCGCCTGTCGGACAGTGGCACCTACACCTGTGTTATTCAGAAG |
| | | CCTGTTTTGAAAGGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTCCTCAACCTCTGGAGGTTTTCCAGAGCCTCGCCTCGCCTGGATGGAAGATGGAGAA |
| | | GAACTAAACGCCGTCAACACGACGGTTGACCAGGATTTGGACACCGAGCTCTACAGCGTCA |
| | | GCAGTGAACTGGATTTCAATGTGACAAATAACCACAGCATCGTGTGTCTCATCAAATACGG |
| | | GGAGCTGTCGGTGTCACACATCTTCCCTTGGAGCAAACCCAAGCACGAGCCTCCCATTGAT |
| | | CAGCTTCCATTCTGGGTCATTATCCCACTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTGA |
| SEQ ID NO:120 | Round 2 CD28F8-4 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAGAGTGAAGAAACACTAATGCTATCCTGTGATTACAGCACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGCACAGTGGCACCTACACCTGTGTTATTCAGAAG |
| | | CCTGTTTTGAAAGGGGCTTATAAACTGGAGCACCTGCCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTCGTTGGAAAATGGAGAA |
| | | GAATTAAATGCTACCAACACAACACTGTCCCAAGATCCTGAAACCAAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTCCTCACTGCAGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTGA |
| SEQ ID NO:121 | Round 2 CD28F10-2 | ATGGGTCACACAATGAAGTGGCGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGATTTGAAAGGGGCTTATAAACTGGAGCACCTGACTTCCGTGAGGTTAATGATCAGAG |
| | | CTGACTTCCCTGTCCCTAGCATAACTGACATTGGACATCCCGCCCCTAATGTGAAAAGGAT |
| | | AAGATGCTCCGCCTCTGGAGATTTTCCAGAGCCTCGCCTCGCCTGGATGGAAGATGGAGAA |
| | | GAACTAAACGCCGTCAACACGACGGTTGACCAGGATTTGGACACGGAGCTCTACAGCGTCA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |

-continued

SEQUENCES

| SEQ ID | Clone ID Name | Sequence |
|---|---|---|
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTGAG |
| SEQ ID NO:122 | Round 2 CD28F12-5* | ATGCGTCACACAATGAAGTGGCQATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGATTTGAAAGGGGCTTATAAACTGGAGCACCTGGCTTCCGTGAGGTTAATGATCAGAG |
| | | CTGACTTCCCTGTCCCTAGCATAACTGACATTGGACATCCCGCCCCTAATGTGAAAAGGAT |
| | | AAGATGCTCCGCCTCTGGAGATTTTCCAGAGCCTCGCCTCGCCTGGATGGAAGATGGGGAA |
| | | GAACTAAACGCCGTCAACACGACGGTTGACCAGGATTTGGACACGGAGCTCTACAGCGTCA |
| | | GCAGTGAACTGGATTTCAATGTGACAAATAACCACAGCATCGTGTGTCTCATCAAATACGG |
| | | GGAGCTCTCGGTGTCACAGATCTTCCCTTGGAGCAAACCCAAGCAGGAGCCTCCCATTGAT |
| | | CAGCTTCCATTCTGGGTCATTATCCCAGTAAGCGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCCGGCTAG |
| SEQ ID NO:123 | Round 2 CD28G2-8 | ATGGGTCACACAATGAAGTGGGGATCACTACCACCCAAGCCCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTCTGATTACAACACATCCACTGAAGAACTG |
| | | ACAAGCCTTCGGATCTATTGGCAAAAGGATAGTAAAATGGTGCTGGCCATCCTCCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGGCTTATAAACTGGAGCACCTGGCTTCCGTGAGGTTAATGATCAGAG |
| | | CTGACTTCCCTGTCCCTAGCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGACCTCTACATGATTA |
| | | GCAGTGAACTGGATTTCAATGTGACAAATAACCACAGCATCGTGTGTCTCATCAAATACGC |
| | | GGAGCTGTCGGTGTCACAGATCTTCCCTTGGAGCAAACCCAAGCAGGAGCCTCCCATTGAT |
| | | CACCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCCGCGCAATCCTCGGGCTGA |
| SEQ ID NO:124 | Round 2 CD28G1-5 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTCTGAC |
| | | CAAAAGAGTGAAAGAAACAGTAATGCTATCCTGTGATTACAGCACATCCACTGAAGAACTG |
| | | ACAAGCCTTCGGATCTATTCGCAAAAGGATAGTAAAATGGTGCTGGCCATCCTGCCTGGAA |

-continued

SEQUENCES

| SEQ ID | Clone ID Name | Sequence |
|---|---|---|
| | | AAGTGCAGGTGTGGCCTGAGTACAAAAACCGCACCTTCCCCGACATCATTAACAACCTCTC |
| | | CCTTATGATCCTGGCACTGCGCCTGTCGGACAAGGGCACCTACACCTGCGTGGTTCAGAAG |
| | | AATGAGAACGGGTCTTTCAGACGGGAGCACCTGACCTCCGTGACACTGTCCATCAGAGCTG |
| | | ACTTCCCTGTCTCTAGCATAACTGACATTGGACATCCCGCCCCTAATGTGAAAAGGATAAG |
| | | ATGCTCCGCCTCTGGAGGTTTTCCAGAGCCTCGCCTCGCCTGGATGGAAGATGGAGAAGAA |
| | | CTAAACGCCGTCAACACGACGGTTGACCAGGATTTGGACACGGAGCTCTACAGCGTCAGCA |
| | | GTGAACTGGATTTCAATGTGACAAATAACCACAGCATTGTGTGTCTCATCAAATACGGGGA |
| | | CCTGTCGGTGTCACAGATCTTCCCTTGGAGCAAACCCAAGCAGGAGCCTCCCATTGATCAG |
| | | CTTCCATTCTGGGTCATTATCCCAGTAAGTGGTGCTTTGGTGCTCACTGCGGTAGTTCTCT |
| | | ACTGCCTGGCCTGCAGACATGTTGCGAGGTGGAAAAGAACAAGAAGGAATGAAGACACAGT |
| | | GGGAACTGAAAGGCTGTCCCCTATCTACTTAGGCTCTGCGCAATCCTCGGGCTGA |
| SEQ ID NO:125 | Round 2 CD2801-9 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAkTGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTCGCTCTGCGCCTGTCGGACAGTGGCACCTACACCTGTGTTATTCAGAAG |
| | | CCTGTTTTGAAAGGGGCTTATAAACTGGAGCACCTGACTTCCGTGAGGTTAATGATCAGAG |
| | | CTGACTTCCCTGTCCCTAGCATAACTGACATTGGACATCCCGCCCCTAATGTGAAAAGGAT |
| | | AAGATGCTCCGCCTCTGGAGGTTTTCCAGAGCCTCGCCTCGCCTGGATGGAAGATGGAGAA |
| | | GAACTAAACGCCGTCAACACGACGGTTGACCAGGATTTGGACACGGAGCTCTACAGCCTCA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTCCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGCCTCTCCGCAATCCTCCGGCTGA |
| SEQ ID NO:126 | Round 2 CD28H4-3 | ATGGGTCACACAATGAAGTGGGGATCACTACCACCCAAGCGCCCATGCCTCTGGCTCTCTC |
| | | AGCTCTTGGTGCTCACTGATCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTCTCGGACAGTGGCACCTACACCTGTGTTATTCAGAAG |
| | | CCTGTTTTGAAAGGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTACATGATTA |
| | | GCAGTGAACTGGATTTCAATGTGACAAATAACCACAGCATCGTGTGTCTCATCAAATACGG |

-continued

SEQUENCES

| SEQ ID | Clone ID Name | Sequence |
|---|---|---|
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCAAGGTGGAAAAGAACAAGAAGCAATGAAGAGAC |
| | | AGTCGGAACTGAAAGGCTGTCCCCTATCTACTTAGGCTCTGCGCAATCCTCGCGCTGA |
| SEQ ID NO:127 | Round 2 CD28H11-3 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTCAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGCAGAA |
| | | GAATTAAATGCTACCAACACAACACTGTCCCAAGATCCTGAAACCAAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCACTAAGTGGTGCTTTGGTGCTCACTGCGCCAGTTC |
| | | TCTACTGCCTGGCCTGCACACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTAG |
| SEQ ID NO:128 | Round 2 CD28H6-6 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAGCACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTAAAAGGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAGGTTTTCCAAGGCCCCACCTCTACTGGTTGGAAAATGGAGAAGAATTAAAT |
| | | GCTACCAACACAACAGTTTCCCAAGATCCTGGAACTCAGCTCTACATGATTAGCACTGAAC |
| | | TGGATTTCAATGTGACAAATAACCACAGCATCGTGTGTCTCATCAAATACGGGGAGCTGTC |
| | | GGTGTCACAGATCTTCCCTTGGAGCAAACCCAAGCAGGAGCCTCCCATTGATCAGCTTCCA |
| | | TTCTGGGTCATTATCCCAGTAAGTGGTGCTTTGGTGCTCACTGCGGTAGTTCTCTACTGCC |
| | | TGGCCTGCAGACATGTTGCGACGTGGAAAAGAACAAGAAGGAATGAAGAGACAGTGGGAAC |
| | | TGAAAGGCTGTCCCCTATCTACTTAGGCTCTGCGCAATCCTCGGGCTGA |
| SEQ ID NO:129 | Round 2 CD28E2-4 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAGCACATCCACTGAAGAACTG |

-continued

| SEQ ID | Clone ID Name | Sequence |
|---|---|---|
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCACTGCGCCTGTCGGACAAGGGCACCTACACCTGTGTTATTCAGAAG |
| | | CCTGTTTTGAAAGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAACAAGGAATGAAGAGAC |
| | | AGTGGGAACTGAAAGGCTGTCCCTATCTACTTAGGCTCTGCGCAATCCTCGGGCTGA |
| SEQ ID NO:130 | Round 2 CD28B4-5a | ATGGCTCACACAATGAAGTGGGGATCACTACCACCCAAGCGCCCATGCCTCTGGCTCTCTC |
| | | ACCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAGCACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGCTTATAAACTGGAGCACCTGGCTTCCGTGACGTTAATGATCAGAG |
| | | CTGACTTCCCTGTCCCTACCATAAATGATCTTGGAAATCCATCTCCTAATATCAGAAGGCT |
| | | AATTGCTCAACCTCTCGACGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCTATCTACTTAGGCTCTGCGCAATCCTCGGGCTAG |
| SEQ ID NO:131 | Round 2 CD28A2-5 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACACTGGCACCTACACCTGTGTTATTCAGAAG |
| | | CCTGATTTGAAAGGCGCTTATAAACTGGAGCACCTGGCTTCCGTGAGGTTAATGATCAGAG |
| | | CTGACTTCCCTGTCCCTAGCATAACTGACATTCGACATCCCGCCCCTAATGTGAAAAGGAT |
| | | AAGATGCTCCGCCTCTGGAGGTTTTCCAGAGCCTCGCCTCGCCTGGATGGAAGATGGAGAA |
| | | GAACTAAACGCCGTCAACACGACGGTTGACCAGGATTTGGACACGGAGCTCTACAGCGTCA |

-continued

SEQUENCES

| SEQ ID | Clone ID Name | Sequence |
|---|---|---|
| | | GCAGTGAACTGGATTTCAACATGACAAGCAATCACAGCTTCTTGTGTCTTGTCAAGTATGG |
| | | AGACTTAACAGTGTCACAGACCTTCTACTGGCAAGAZkTCCAAACCAACCCCTTCTGCTAAT |
| | | CAGCACCTGACCTGGACCATTATTATCCCAGTCTCAGCATTTGGGATTTCTGTGATCATTG |
| | | CAGTTATACTAACATGCCTGACCTGCAGAAATGCTGCAATACGCAGACACAGAAGGGAGAA |
| | | TGAAGGGAAATGCAAAGTGCTCTCAGTCTCCATACGTACCAAGCTTAAGTTTAACCGC |
| SEQ ID NO:132 | Round 2 CD28B4-5* | ATGGGTCACACAATGAAGTGGGGATCACTACCACCCAAGCGCCCATGCCTCTGGCTCTCTC AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAAGGGCACCTACACCTGCGTGGTTCAGAAG |
| | | CCTGATTTGAAAGGGGCTTATAAACTGGAGCACCTGGCTTCCGTGAGGTTAATGATCAGAG |
| | | CTGACTTCCCTGTCCCTAGCATAACTGACATTGGACATCCCGCCCCTAATGTGAAAAGCAT |
| | | AAGATGCTCCGCCTCTGGAGGTTTTCCAGAGCCTCGCCTCGCCTGGATGGAAGATGGAGAA |
| | | GAACTAAACGCCGTCAACACGACGGTTGACCAGGATTTGGACACGGAGCTCTACAGCGTCA |
| | | GCAGTGAACTGGATTTCAATGTGACAAATAACCACAGCATCGTGTGTCTCATCAAATACGG |
| | | GGAGCTGTCGGTGTCACAGATCTTTCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCTATCTACTTAGGCTCTGCGCAATCCTCGGGCTGA |
| SEQ ID NO:133 | Round 2 CD25D5-6 | ATGGGTCACACAATGAAGTGGGGATCACTACCACCCAAGCGCCCATGCCTCTGGCTCTCTC AGCTCTTGGTGCTCACTGGTCTTTTTTACTTCTGTTCAGGCATCACCCCAAAGACTGTGAC |
| | | CAAAAGAGTGAAAGAAACAGTAATGCTATCCTGTGATTACAGCACATCCACTGAACAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGGCTTATAAACTGGAGCACCTGACTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATCGAGAA |
| | | GAATTAAATGCTACCAACACAACACTGTCCCAAGATCCTGAAACCAAGCTCTACATGATTA |
| | | GCAGTGACTGGATTTCAACATGACAAGCAATCACAGCTTCTTGTGTCTTGTCAAGTATGG |
| | | AGACTTAACAGTGTCACAGTCCTTCTACTGGCAAGAATCCAAACCAACCCCTTCTGCTAAT |
| | | CAGCACCTGACCTGGACCATTATTATCCCAGTCTCAGCATTTGGGATTTCTGTGATCATTC |
| | | CAGTTATACTAACATGCCTGACCTGCAGAAATGCTGCAATACGCAGACAGAGAAGGGAGAA |
| | | TGAAGTGGAAATGCAAAGTTGCTCTCAGTCTCCATGA |
| SEQ ID NO:134 | Round 2 CD28D10-4 | ATGGGTCACACAATGAAGTC3GGGATCACTACCACCCAAGCGCCCATGCCTCTGGCTCTCTC AGCTCTTGGTGCTCACTGGTCTTTTTTACTTCTGTTCAGGCATCACCCCAAAGAGTGTGAC |

| SEQ ID | Clone ID Name | Sequence |
|---|---|---|
| | | CAAAAGAGTGAAAGAAACAGTAATGCTATCCTGTGATTACAACACATCCACTGAAGAACTG |
| | | ACAACCCTTCCGATCTATTGGCAAAAGGATAGTAAAATGGTCCTGGCCATCCTGCCTGGAA |
| | | AAGTGCACGTGTGGCCTGAGTACAAGAACCCCACCATCACTCACATGAACGATAACCCCCG |
| | | TATTGTGATCCTGGCTCTGCGCCTGTCGGACAAGGGCACCTACACCTGCGTGGTTCAGAAG |
| | | AATGAGAACGGGTCTTTCAGACGGGAGCACCTGACCTCCGTGACACTGTCCATCAGAGCTG |
| | | ACTTCCCTGTCCCTAGCATAACTGACATTGGACATCCCGCCCCTAATGTGAAAAGGATAAG |
| | | ATGCTCCGCCTCTGGACGTTTTCCAGAGCCTCGCCTCGCCTGGATGGAAGATGGAGAAGAA |
| | | CTAAACGCCGTCAACACGACGGTTGACCAGGATTTGGACACGGAGCTCTACAGCGTCAGCA |
| | | GTGAACTGGATTTCAATGTGACAAATAACCACAGCATCGTGTGTCTCATCAAATACGGGGA |
| | | GCTGTCGGTGTCACAGATCTTCCCTTGGAGCAAACCCAAGCAGGAGCCTCCCATTGATCAC |
| | | CTTCCATTCTGGGTCATTATCCCAGTAAGTGGTGCTTTGCTGCTCACTGCGGTAGTTCTCT |
| | | ACTGCCTGGCCTGCAGACATGTTGCGAGGTGGAAAAGAACAAGAAGGAATGAAGAGACAGT |
| | | GGGAACTGAAAGGCTGTCCCTATCTACTTAGGCTCTGCGCAATCCTCGGGCTAG |
| SEQ ID NO:135 | Round 2 CD28E2-5* | ATGGGTCACACAATGAAGTGGGGATCACTACCACCCAAGCGCCCATGCCTCTGGCTCTCTC |
| | | AGCTCTTGGTGCTCACTGGTCTTTTTACTTCTGTTCAGGCACCACCCCAAAGAGTGTGAC |
| | | CAAAAGAGTGAAAGAAACAGTAATGCTATCCTGTGATTACAACACATCCACTGAAGAACTG |
| | | ACAAGCCTTCCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCCGTCGGACAGTGGCACCTACACCTGTGTTATTCAGAAG |
| | | CCTGTTTTGAAAGGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAATGCTACCAACACAACACTGTCCCAIkGATCCTGAAACCAAGCTCTACATGATTA |
| | | GCAGTGAACTGGATTTCAACATGACAAGCAATCACAGCTTCTTGTGTCTTGTCAAGTATGG |
| | | AGACTTAACAGTGTCACAGACCTTCTACTCGCAAGAATCCAAACCAACCCCTTCTGCTAAT |
| | | CAGCACCTGACCTGGACCATTATTATCCCAGTCTCAGCATTTGGGATTTCTGTGATCATTG |
| | | CAGTTATACTAACATGCCTGACCTGCAGAAATGCTGCAATACGCAGACAGAGAAGGGAGAA |
| | | TGAAGTGGAAATGCAAAGTTGCTCTCAGTCTCCATGA |
| SEQ ID NO:136 | Round 2 CD28E5-2 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCCGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGATTTGAAAGGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |

| SEQ ID | Clone ID Name | Sequence |
|---|---|---|
| | | GAATTAAATGCTACCAACACAACACTGTCCCAAGATCCTGAAACCAAGCTCTACATGATTA |
| | | GCAGTGAACTGGATTTCAATGTGACAAATAACCGCAGCATCGTGTGTCTCATCAAATACGG |
| | | GGAGCTGTCCGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGGCTGA |
| SEQ ID NO:137 | Round 2 CD28E8-6 | ATGGGTCACACAATGAAGTGGGCATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AACTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGTGTTATTCAGAAG |
| | | CCTGTTTTGAAAGGGCTTATAAACTGGAGCACCTGACTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGAAACCAAGCTCTACATGATTA |
| | | GCAGTGAACTGGATTTCAACACGACAAGCAATCACAGCTTCTTGTGTCTTGTCAAGTATGG |
| | | AGACTTAACAGTGTCACAGACCTTCTACTGGCAAGAATCCAAACCAACCCCTTCTGCTAAT |
| | | CAGCACCTGACCTGGACCATTATTATCCCAGTCTCAGCATTTGGGATTTCTGTGATCATTG |
| | | CAGTTATACTAACATGCCTGACCTGCAGAAATGCTGCAATACGCAGACAGAGAAGGGAGAA |
| | | TGAAGTGGAAATGCAAAGTTGCTCTCAGTCTCCATGA |
| SEQ ID NO:138 | Round 2 CD28E9-6 | ATGGGTCACACAATGAAGTGGGGATCACTACCACCCAAGCGCCCATGCCTCTGGCTCTCTC |
| | | AGCTCTTGGTGCTCACTGGTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTCTCCGACAAGGGCACCTACACCTGTGTTATTCAGAAG |
| | | CCTGATTTGAAAGGGCTTATAAACTGGAGCACCTGGCTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACAGTTTCCCAAGATCCTGGAACTGAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTGGGTCATTATCCCAGTAAGTGGTGCTTTGGTGCTCACTGCGGTAGTTC |
| | | TCTACTGCCTGGCCTGCAGGCATGTTGCGAGGTGGAAAAGAACAAGAAGGAATGAAGAGAC |
| | | AGTGGGAACTGAAAGCCTGTCCCCTATCTACTTAGGCTCTGCGCAATCCTCGGGCTGA |

-continued

SEQUENCES

| SEQ ID | Clone ID Name | Sequence |
|---|---|---|
| SEQ ID NO:139 | Round 2 CD28F3-1 | ATGGGTCACACAATGAAGTGGGGATCACTACCACCCAAGCGCCCATGCCTCTGGCTCTCTC<br>AGCTCTTGGTGCTCACTGGTCTTTTTTACTTCTGTTCACGCATCACCCCAAAGAGTGTGAC<br>CAAAAGAGTGAAAGAAACAGTAATGCTATCCTGTGATTACAACACATCCACTGAAGAACTG<br>ACAAGCCTTCGGATCTATTGGCAAAAGGATAGTAAAATGGTGCTGGCCATCCTGCCTGGAA<br>AAGTGCAGGTGTGGCCTGAGTACAAGAACCGCACCATCACTGACATGAACGATAACCCCCG<br>TATTGTGATCCTGGCTCTGCGCCTCTCGGACAGTGGCACCTACACCTGTGTTATTCAGAAG<br>CCTGATTTGAAAGCGGCTTATAAACTGGAGCACCTGACTTCCGTGAGGTTAATGATCAGAG<br>CTGACTTCCCTGTCCCTACCATAAATGATCTTGGAAATCCATCTCCTAATATCAGAAGGCT<br>AATTTGCTCAACCTCTGGAGGTTTTCCAAGGCCCCACCTCTACTGGTTGGAAAATGGAAAA<br>GAATTAAATGCTACCAACACAACACTGTCCCAAGATCCTGAAACCAAGCTCTACATGATTA<br>GCAGTGAACTGGATTTCAACATGACAAGCAATCACAGCTTCTTGTGTCTTGTCAAGTATGG<br>AGACTTAACAGTGTCACAGACCTTCTACTGGCAAGAATCCAAACCAACCCCTTCTGCTAAT<br>CAGCACCTGACCTGGACCATTATTATCCCAGTCTCAGCATTTGGGATTTCTGTGATCATTG<br>CAGTTATACTAACATGCCTGACCTGCAGAAATGCTGCAATACGCAGACAGAGAAGGGAGAA<br>TGAAGTGGAAATGCAAAGTTCCTCTCAGTCTCCATGA |
| SEQ ID NO:140 | Round 2 CD28F3-5 | ATGGGTCACACAATGAAGTGGGGATCACTACCACCCAAGCGCCCATGCCTCTCGCTCTCTC<br>AGCTCTTGGTGCTCACTGGTCTTTTTTACTTCTGTTCAGGCATCACCCCAAACAGTCTGAC<br>CAAAAGAGTGAAAGAAACAGTAATGCTATCCTGTGATTACAACACATCCACTGAAGAACTG<br>ACAAGCCTTCGGATCTATTGGCAAAAGGATAGTAAAATGGTGCTGGCCATCCTGCCTGGAA<br>AAGTGCAGGTGTGGCCTGAGTACAAGAACCGCACCATCACTGACATGAACGATAACCCCCG<br>TATTGTGATCCTGGCTCTGCGCCTGTCGGACAGTGGCACCTACACCTGCCTGGTTCAGAAC<br>AATGAGAACGGGTCTTTCAGACGGGAGCACCTGACCTCCGTGACACTGTCCATCAGAGCTG<br>ACTTCCCTCTCCCTAGCATAACTGACATTGGACATCCCGCCCCTAATGTGAAAAGGATAAG<br>ATGCTCCGCCTCTGGAGGTTTTCCAGAGCCTCGCCTCGCCTGGATGGAAGATGGAGAAGAA<br>CTAAACGCCGTCAACACGACGGTTGACCAGGATTTGGACACGGAGCTCTACAGCGTCAGCA<br>GTGAACTGGATTTCAATGTGACAAATAACCACAGCATCGTGTGTCTCATCAAATACCGGGA<br>GCTGTCGGTGTCACAGATCTTCCCTTGGAGCAAACCCAAGCAGGAGCCTCCCATTGATCAG<br>CTTCCATTCTGGGTCATTATCCCAGTAAGTGGTGCTTTGGTGCTCACTGCGGTAGTTCTCT<br>ACTGCCTGGCCTGCAGACATGTTGCGAGGTGGAAAAGAACAAGAAGGAATGAAGAGACAGT<br>GGGAACTGAAAGCCTGTCCCCTATCTACTTAGGCTCTGCGCAATCCTCGGGCTGAG |
| SEQ ID NO:141 | Round 2 CD28F3-6 | ATGGGTCACACAATGAAGTGGGGATCACTACCACCCAAGCGCCCATGCCTCCGGCTCTCTC<br>AGCTCTTGGTGCTCACTGGTCTTTTTTACTTCTGTTCAGGCATCACCCCAAAGAGTGTGAC<br>CAAAAGAGTGAAAGAAACAGTAATGCTATCCTGTGATTACAGCACATCCACTGAAGAACTG<br>ACAAGCCTTCGGATCTATTGGCAAAAGGATAGTAAAATGGTGCTCGCCATCCTGCCTGGAA<br>AAGTGCAGGTGTGGCCTGAGTACAAGAACCGCACCATCACTGACATGAACGATAACCCCCG<br>TATTGTGATCCTGGCTCTGCGCCTGTCGGACAGTGGCACCTACACCTGTGTTATTCAGAAG<br>CCTGATTTGAAAGGGGCTTATAAACTGCAGCACCTGACTTCCGTGAGGTTAATGATCAGAG |

-continued

SEQUENCES

| SEQ ID | Clone ID Name | Sequence |
|---|---|---|
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACACTGTCCCAAGATCCTGAAACCAAGCTCTACATGATTA |
| | | GCAGTGAACTGGATTTCAATGTGACAAATAACCACAGCATCGTGTGTCTCATCAAATACGG |
| | | GGAGCTGTCGGTGTCACAGATCTTCCCTTGGAGCAAACCCAAGCAGGAGCCTCCCATTGAT |
| | | CAGCTTCCATTCTCGGTCATTATCCCAGTAAGTGGTGCTTTGGTGCTCACTGCGGTAGTTC |
| | | TCTACTGCCTGGCCTGCAGACATGTTGCGAGGTGGAAAAGAACAAGAAGGAATGAAGAGAC |
| | | AGTGGGAACTGAAAGGCTGTCCCCTATCTACTTAGGCTCTGCGCAATCCTCGGCCTGA |
| SEQ ID NO:142 | Round 2 CD28F11-8 | ATGGGTCACACAATGAAGTGGGGATCACTACCACCCAAGCGCCCATGCCTCTGGCTCTCTC |
| | | AGCTCTTGGTGCTCACTGCTCTTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCCGACAGTGGCACCTACACCTGTGTTATTCAGAAG |
| | | CCTGTTTTGAAAGGGCTTATAAACTGGAGCACCTGACTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGCAGGTTTTCCAAGGCCCCACCTCTACTGGTTGGAAAATGGAGAA |
| | | GAATTAAATGCTACCAACACAACACTGTCCCAAGATCCTGAAACCAAGCTCTACATGATTA |
| | | GCAGTGAACTGGATTTCAACATGACAAGCAATTTGTGTCTTGTCAAGTATGGAGACTTAAC |
| | | AGTGTCACAGACCTTCTACTGGCAAGAATCCAAACCAACCCCTTCTGCTAATCAGCACCTG |
| | | ACCTGGACCATTATTATCCCAGTCTCAGCATTTGGGATTTCTGTGATCATTGCAGTTATAC |
| | | TAACATGCCTGACCTGCAGAAATGCTGCAATACGCAGACAGAGAAGGGAGAATGAAGTGGA |
| | | AATGCAAAGTTGCTCTCAGTCTCCATGA |
| SEQ ID NO:143 | Round 2 CTLA4BP 5x9-d10 | ATGAGCCACACACGGAGGCAGGGAACATCACCATCCAAGTGTCCGTACCTCAAGTTCTTTC |
| | | AGTTCTTGGTGCTGGCTAGTCTTTCTCATTTCTGTTCAGGTGTTATCCACGTGACTAAGGA |
| | | AGTGAAAGAAGTGGCAACGCTGTCCTGTGGTCTCAATGTTTCTGTTGAAGAGCTGGCACAA |
| | | ACTCGCATCTACTGGCAAAAGGGGAAGAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGGAGTATGAA |
| | | AAAGATGCTTTCAAGCGAGAACACCTGGCTGAAGTGATGTTATCCGTCAAACCTGACTTCC |
| | | CTACACCTAGTATATCTGACTTTGAAATTCCACCTTCTAACATTAGAAGGATAATTTGCTC |
| | | AACCTCCGGAGGTTTTCCTGAGCCTCACCTCTCCTGGCTGGAAAATGGAGAAGAATTAAAT |
| | | GCCATCAACACAACAGCTTCCCAAGATCCTGGAACTGAGCTCTATACTGTTAGCAGCAAAC |
| | | TGGATTTCAATATGACAACCAACCACAGCTTCATGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGTAAATGGAATTTTTGTGATATGCTGCCTGACCC |

-continued

SEQUENCES

| SEQ ID | Clone ID Name | Sequence |
|---|---|---|
| | | ACTGTTTTGCCCCAAGATGCAGAGAGAGAAGGAGGAATGAGAGATTGAGAAGGGAAAGTGC |
| | | ACGCCCTGTATGA |
| SEQ ID NO:144 | Round 2 CTLA4BP 5x6-f6 | ATGGGCTACACACGGAGGCAGGGAACATCACCATCCAAGTGTCCGTACCTCAAGTTCTTTC |
| | | AGCTCTTGGTGCTGGCTAGTCTTTCTCATTTCTGTTCAGGTGTTATCCACGTGACCAACGA |
| | | AGTGAAAGAAGTGGCAACGCTGTCCTGTGGTCACAATGTTTCTGTTGAAGAGCTGGCACAA |
| | | ACTCCCATCTACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGACGCTTTCAAGCGAGAACACCTGGCTGAAGTGATGTTATCCGTCAAAGCTGACTTCC |
| | | CTACACCTAGTATAACTGACTTTGAAATTCCACCTTCTAACATTAGAAGGATAATTTGCTC |
| | | AACCTCCGGAGGTTTTCCTGAGCCTCACCTCTTCTGGCTGGAAAATGGAGAAGAATTAAAT |
| | | GCCATCAACACAACAGTTTCCCAAGATCCTGAAACTGAGCTCTATACTGTTAGCAGCAAAC |
| | | TGGATTTCAATATGACAACCAATCGAGTTTTGTGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGCAAATGGAATTTTTGTGATATGCTGCCTGACCT |
| | | ACCGCTTTGCCCCAAGATGCAGAGAGAGAAGGAGGAATGAGAGGCTGAGAAGGGAAAGTGT |
| | | ATGCCCTGTATGAG |
| SEQ ID NO:145 | Round 2 CTLA4BP 5c5-h12 | ATGGGCTACACACGGAGGCAGGGAATATCACCATCCAAGTGTCCATACCTCAAGTTCTTTC |
| | | AGCTCTTGGTGCTGGCTAGTCTTTCCCACTTCTGTTCAGGTGTTATCCACGTGACCAAGAA |
| | | AGTGAAAGAAGTGGCAACGCTGTCCTGTCGTCACAATGTTTCTGTTGAAGAGCTGGCACAA |
| | | ACTCGCATCCACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACCAGGGCACATACGAATGTGTTGTTCTGAAGTATGAA |
| | | AAAGATGCTTTCAAGCGGGAACACCTGGCTGAAGTGATGTTATCCGTCAAAGCTGACTTCC |
| | | CTACACCTAGTATATCTGACTTTGAAATTCCACCTTCTAACATTAGAAGGATAATTTGCTC |
| | | AACCTCTGGAGGTTTTCCAGAGCCTCACCTCTCCTGGCTGGAAAATGGAGAAGAATTAAAT |
| | | GCCATCAACACAACAGTTTCCCAAGATCCTGGAACTGAGCTCTATACTGTTAGCAGCAAAC |
| | | TGGATTTCAATATGACAACCGATCGCAGTTTTGTGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCCTAATCTCAGTAAATGGAATTTTTGTGATATGCTGCCTGACCT |
| | | ACTGCTTTGCCCCAAGATGCAGAGAGAGAGGGAGGAATGGGAGATTGAGAAGGGAAAGTGT |
| | | ACGCCCTGTATGA |
| SEQ ID NO:146 | Round 2 CTLA4BP 5x5-c10 | ATGAGCCACACACAGAGGCAGGGAATATCACCATCCAAGTGTCCATACCTCAATTTCTTTC |
| | | AGCTCTTGGTGCTGGCTAGTCTTTCTCATTTCTGTTCAGGTGTTATCCACGTGACCAAGGA |
| | | AGTGAAAGAAGTGGCAACACTGTCCTGTGGTCACAATGTTTCTGTTGAAGAGCTGGCACAA |
| | | ACTCGCATCTACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |

-continued

| SEQ ID | Clone ID Name | Sequence |
|---|---|---|
| | | GATTCTGGCTCTGCCCCCATCTGACGAGGGCACATACGAGTGTGTTGTTCTGGAGTATGAA |
| | | AAAGACGCTTTCAAGCGGGAGCACCTAGCTGAAGTGACGTTATCAGTCAAAGCTGACTTCC |
| | | CTACACCTAGTATAACTGACTTTGAAATTCCACCTTCTAACATTAGAAGGATAATTTGCTC |
| | | AACCTCTGGAGGTTTTCCAGAGCCCCACCTCTTCTGGCTGGAAAATGGAGAAGAATTAAAT |
| | | GCCATCAGCACAACAGTTTCCCAAGATCCTGAAACTGAGCTCTATGCTGTCAGCAGCAAAC |
| | | TGGATTTCAATATGACAACCAACCACAGCTTCATGTGTCTCATCAAGTATGGACATTTAAG |
| | | AGTGAATCAGACCTTCAACTGGAATACAACCAAGCAAGAGCATTTTCCTGATAACCTGCTC |
| | | CCATCCTGGGCCATTACCTTAATCTCAGTAAATGGAATTTTTGTGATATGCTGCCTGACCT |
| | | ACTGCTTTGCCCCAAGATGCAGAGAGAGGAGAAGGAATGAGAGATTGAGAAGGGAAAGTGT |
| | | ACACCCTGTATGAG |
| SEQ ID NO:147 | Round 2 CTLA4BP 5x3-e8 | ATGGGCCACACACGGAGGGAGGGAACATCACCATCCAAGTGTCCATACCTCAAGTTCTTTC |
| | | AGCTCTTGGTGCTGGCTGGTCTTTCTCATCTCTGTTCAGGTGTTATCCACGTGACCAAGGA |
| | | AGTGAAAGAAGTGGCAACACTGTCCTGTGGTCACAATGTTTCTGTTGAAGAGCTGGCACAA |
| | | ACTCGCATCTACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGGAGTATGAA |
| | | AAAGACGCTTTCAAGCGGGAACACCTAGCTGAAGTGACGTTATCAGTCAAAGCTGACTTCC |
| | | CTACACCTAGTATATCTGACTTTGAAATTCCGACTTCTAATATTAGAAGGATAATTTGCTC |
| | | AACCTCTGGAGGTTTTCCAGAGCCTCACCTCTTCTGGCTGGAAAATGGAGAAGAATTAAAT |
| | | GCCATCAACACAACAGTTTCCCAAGATCCTGAAACTGAGCTCTATACTGTTAGCAGCAAAC |
| | | TCGATTTCAATATGACAGCCAATCACAGTTTTGTGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGTAAATGGAATTTTTGTGATATGCTGCCTGACCT |
| | | ACTGCTTTGCCCCAGGATGCAGAGAGAGAAGGAGGAATGAGAGATTGAGAAGGGAAAGTGT |
| | | ATCCCCTGTATAG |
| SEQ ID NO:148 | Round 2 CTLA4BP 5x3-c4 | ATGAGCCACATACGGAGGCAGGGAATATCACCATCQAAGTGTCCATACCTCAATTTCTTTC |
| | | AGCTCTTGGTGCTGGCTTGTCTTTCTCATTTCTGTTCAGGTGTTATCCACGTGACCAAGGA |
| | | AGTGAAAGAAGTCGCAACACTGTCCTGTGGTCACAATGTTTCTGTTGAAGAGCTGGCACAA |
| | | ACTCGCATCTACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCCGACGAGGGCACATACGAGTCTGTTGTTCTGAAGTATGAA |
| | | AAAGACGCTTTCAAGCGGGAACACCTGGCTGAAGTGACGTTATCAGTCAAAGCTGACTTCC |
| | | CTACACCTAGTATATCTGACTTTGAAATTCCACCTTCTAACATTAGAAGGATAATTTGCTC |
| | | AACCTCTGGAGGTTTTCCAGAGCCTCGCCTCGCCTGGATGGAAGATGGAGAAGAACTAAAT |
| | | GCCATCAACACAACAGCTTCCCAAGATCCTGAAACTGAGCTCTATACTGTTAGCAGCAAAC |
| | | TGGATTTCAATATGACAACCAATCGCAGTTTTGTGTGTCTCATCAAGTATGGACATTTAAG |
| | | AGTGAATCAGACCTTCAACTGCAATACACCCAAGCAAGAGCATTTTCCTCATAACCTGTTC |

-continued

SEQUENCES

| SEQ ID | Clone ID Name | Sequence |
|---|---|---|
| | | CCATCCTGGGCCATTACCCTAATCTCAGTAAATGGAATTTTTGTGATATGCTGCCTGACCT |
| | | ACTGCTTTGCCCCAAGATGCAGAGAGAGAAGGAGGAATGAGAGATTGAGAAGGGAAAGTGT |
| | | ACGCCCTGTATGA |
| SEQ ID NO:149 | Round 2 CTLA4BP 5x3-c3 | ATGAGCCACACACGGAGGCAGGGAACATCACCATCCAAGTGTCCGTACCTCAAGTTCTTTC |
| | | AGCTCTTGGTGCTGGCTAGTCTTTCTCACTTCTGTTCAGGTGTTATCCACATGACCAAGGA |
| | | AGTGAAAGAAGTGGCAACGCTGTCCTGTGGTCCCAATGTTTCCGTTGAAGAGCTGGCACAA |
| | | ACTCGCATCTACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTCGCTCTCCGCCCATCTGACGAGGGCACATACGAGTGTGTTGTTCTGAAGTATGAA |
| | | AAAGATGCTTTCAAGCGAGAACACCTGCCTGAAGTGACGTTATCAGTCAAACCTGACTTCC |
| | | CTACACCTAGTATATCTGACTTTGAAATTCCAACTTCTAACATTAGAAGGATAATTTGCTC |
| | | AACCTCTGGAGGTTTTCCTGAGCCTCACCTCTCCTGGCTGGAAAATGGAGAAGAATTAAAT |
| | | GCCATCAACACAACAGTTTCCCAAGATCCTGGAACTGAGCTCTATACTGTTAGCAGCAAAC |
| | | TGGATTTCAATATGACAACCAACCACAGCTTCATGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGTAAATGGAATTTTTGTGATATGCTGCCTGACCC |
| | | ACTGTTTTGCCCCAAGATGCAGAGAGAGAAGGAGGAATGACAGATTGAGAAGGGAAAGTGT |
| | | ATGCCCTGTATAG |
| SEQ ID NO:150 | Round 2 CTLA4BP 5x2-h11 | ATGAGCCACACACGGAGGCAGGGAATATCATCATCCAAGTGTCCATACCTCAAGTTCTTTC |
| | | AGCTCTTGGTGCTGGCTTGTCTTTCTCATTTCTGTTCAGGTGTTATCCACGTGACCAAGAA |
| | | AGTGAAAGAAGTGGCAACACTGTCCTGTGGTCACAATGTTTCTGTTGAAGAGCTGGCACAA |
| | | ACTCGCATCTACTGGCAAAAGGGGAAGAAAATGGTGCTGACTATGATGTCTGGGGACATGA |
| | | ATATATGGCCCGAGTGCAAGAACCGGACCATCTTTGATATCACTAATAACCTCTCCATTGT |
| | | GATTCTGGCTCTGCGCCCATCTGACGAGGGCACATACGAGTGTGCTGTTCTGAAGTATGAA |
| | | AAAGACGCTTTCAAGCGGGAACACCTAGCTGAAGTGACGTTATCAGTCAAAGCTGACTTCC |
| | | CTACACCTAGTATATCTGACTTTGAAATTCCAACTTCTAATATTAGAAGGATAATTGCTC |
| | | AACCTCTGGAGGTTTTCCAGAGCCTCACCTCTTCTGGTTGGAAAATGGGGAAGAATTAAAT |
| | | GCCATCAACACAACAAGCTTCCCAGATCCTGAAACTGACCTCTATGCTGTTAGCAGCAAAC |
| | | TGGATTTCAATATGACAACCAACCACAGCTTCATGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGTAAATGGAATTTTTGTGATATGCTGCCTGACCT |
| | | ACTGCTTTGCCCCAAGATGCAGAGAGAGAAAGAGCAATGAGAGACTGAGAAGGCAAAGTGT |
| | | ACGCCCTGTATGA |
| SEQ ID NO:151 | Round 2 CTLA4BP 5x2-d7 | ATGGGCTACACACGGAGGCAGGGAACATCACCATCCGAGTGTCCATACCTCAAGTTCTTTC |
| | | AGCTCTTGGTGCTGGCTGGTCTTTCTCACTTCTGTTCAGGTGTTATCCACATGACCAAGGA |
| | | AGTGAAAGAAGTGGCAACACTGTCCTGTGGTCTCAATGTTTCTGTTGAAGAGCTGGCACAA |
| | | ACTCGCATCCACTGGCAAAAGGAGAAGAAAATGGTGCTGACTATGATGTCTGGGGACATGA |

-continued

SEQUENCES

| SEQ ID | Clone ID Name | Sequence |
|---|---|---|
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGATGCCTTCAAGCGCGAACACCTGGCTGAAGTGATGTTATCAGTCAAAGCTGACTTCC |
| | | CTACACCTAGTATATCTGACTTTGAAATTCCACCTTCTAACATTAGAAGGATAATTTGCTC |
| | | AACCTCTGGAGGTTTTCCTGAGCCTCACCTCTCCTGGCTGGAAAATGGAGAAGAATTAAAT |
| | | GCCATCAACACAACAGTTTCCCAAGATCCTGAAACTGGGCTCTATACTGTTAGCAGCAAAC |
| | | TGGATTTCAATATGACAACCAACCACACCTTCATGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCCTAATCTCAGTAAATGGAATTTTTGTGTATATCCTGCCTGACCT |
| | | ACTGCTTTGCCCCAAGATGCAGAGAGAGAAGGAGGAATGAGAGACTGAGAAGGGAAAGTGT |
| | | ACGCCCTGTATGA |
| SEQ ID NO:152 | Round 2 CTLA4BP 5x2-b7 | ATGAGCCACACACGGAGGCAGGGAATATCACCATCCAAGTGTCCATACCTCAATTTCTTTC |
| | | GGCTCTTGGTGCTGGCTAGTCTTTCTCATTTCTGTTCAGGTGTTATCCACGTGACCAAGGA |
| | | AGTGAAAGAAGTGGCAACACTGTCCTGTGGTCACAATGTTTCTGTTGAAGAGCTGGCACAA |
| | | ACTCGCATCCACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGACGCTTTCAAGCGAGAACACCTAGCTGAAGTGACGTTATCAGTCAAAGCTGACTTCC |
| | | CTACACCTAGTATAACTGACTTTGAAATTCCACCTTCTAACATTAGAAGGATAATTTGCTC |
| | | AACCTCTGGAGGTTTTCCAGAGCCTCACCTCTCCTGGCTGGAAAATGGAGAAGAATTAAAT |
| | | CCCATCAACACAACAGTTTCCCAAGATCCTGGAACTGAGCTCTATACTGTTAGCAGCAAAC |
| | | TGGATTTCAATATGACAGCCAATCACAGTTTTGTGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGCAAATGGAATTTTTGTGTATATCCTCCCTGACCT |
| | | ACTGCTTTGCCCCAAGATGCAGAGAGAGAAGGAGGAATGAGAGATTGAGAAGGGAAAGTGT |
| | | ACGCCCTGTATGA |
| SEQ ID NO:153 | Round 2 CTLA4BP 5x2-b1 | ATGAGCCACACACGGAGGCAGGGAATATCACCATCCAAGTGTCCATACCTCAAGTTCTTTC |
| | | AGCTCTTGGTGCTGGCTAGTCTTTCTCATTTCTGTTCAGGTGTTATCCACGTGACCAAGGA |
| | | AGTGAAAGAAGTGGCAACGCTGTCCTGTGGTCACAATGTTTCTGTTGAAGAGCTGGCACAA |
| | | ACTCGCATCTACTGGCAAAAGGAGAAGAAAATGGTGCTGACTATGATGTCTGGGGACATGA |
| | | ATATATGGCCCGAGCACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGACGCTTTCAAGCGGGAACACCTGCCTGAAGTGATGTTATCCGTCAAAGCTGACTTCC |
| | | CTACACCTAGTATATCTGACTTTGAAATTCCACCTTCTAACATTAGAAGGATAATTTGCTC |
| | | AACCTCCGGAGGTTTTCCTGAGCCTCACCTCTCCTGGCTGGAAAATGGAGAAGAATTAAAT |
| | | GCCATCAACACAACAGTTTCCCAAGATCCTGAAACTGAGCTCTATACTGGTAGCAGCAAAC |
| | | TGGATTTCAATATGACAACCAACCACAGCTTCATGTGTCTCATCAAGTATGGACATTTAAG |

-continued

SEQUENCES

| SEQ ID | Clone ID Name | Sequence |
|---|---|---|
| | | AGTGAATCAGACCTTCAGCTGGAATACACCCAAGCAAGAGCATTTTCCTGATAACCTGCTC |
| | | CCATCCTGGGCCATTACCCTAATCTCAGCAAATGGAATTTTTGTGATATGCTGCCTGACCT |
| | | ACTGCTTTGCCCCAAGATGCAGAGAGAGAAGGAGGAATGAGACCCTGAGAAGGGAAAGTGT |
| | | ACGCCCTGTATGGGGTACCAAGCTTAAGTTTAAACCGCNNATCAGCC |
| SEQ ID NO:154 | Round 2 CTLA4BP 5x1-f1 | ATGGCCCACACACCGAGGCAGGGAATATCACCATCCAAGTGTCCATACCTCAAGTTCTTTC |
| | | AGCTCTTGGTGCTGGCTAGTCTTTCTCATTTCTGTTCAGGTGTTATCCACGTGACTAAGGA |
| | | AGTGAAAGAAGTGGCAACGCTGTCCTGTGGTCTCAATGTTTCTGTTGAAGAGCTGGCACAA |
| | | ACTCGCATCTACTGGCAAAAGGAGAAGAAAATGGTGCTGACTATGATGTCTGGGGACATGA |
| | | ATATATGGCCCGAGCACAAGAACCGGCCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGACGCTTTCAAGCGGGAACACCTAGCTGAAGTGACGTTATCAGTCAAAGCTCACTTCC |
| | | CTACACCTAGTATAACTGACTTTGAAATTCCACCTTCTAACATTAGAAGGATAATTTGCTC |
| | | AACCTCCGGAGGTTTTCCTGAGCCTCACCTCTTCTGGCTGGAAAATGGAGAAGAATTAAAC |
| | | GCCATCAACACAACAGCTTCCCAAGATCCTGAAACTGAGCTCTATACTGTTAGCAGCAAAC |
| | | TGGATTTCAATATGACAGCCAATCACAGTTTTGTGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGTAAATGGAATTTTTGTGATATGCTGCCTGACCT |
| | | ACTGCTTTGCCCCAAGATGCAGAGAGAGGAGAAGGAATGAGACACTGAGAAGGGAAAGTGT |
| | | ACGCCCTGTATGA |
| SEQ ID NO:155 | Round 2 CTLA4BP 5x1-d7 | ATGGGCTACACACGGAGGCAGGGAACATCACCATCCAAGTGTCCATACCTCAATTTCTTTC |
| | | AGCTCTTGGTGCTAGCTAGTCTTTCTCACTTCTGTTCAGGTGTTATCCACGTGACCAAGGA |
| | | AGTGAAAGAAGTGGCAACGCTGTCCTGTGGTCACAATGTTCCTGTTGAAGAGCTGGCACAA |
| | | ACTCGCATCTACTGGCAAAAGGAGAAGAAAATGGTGCTGACTATGATGTCTGGGGACATCA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGGGTGTGTTGTTCTGGAGTATGAA |
| | | AAAGACGCTTTCAAGCGAGAACACCTGGCTGAAGTGATGTTATCCGTCAAAGCTGACTTCC |
| | | CTACACCTAGTATAACTGACCTTGAAATTCCACCTTCTAACATTAGAAGGATAATTTGCTC |
| | | AACCTCTGGAGGTTTTCCAGAGCCTCACCTCTTCTGGTTGGAAAATGGGGAAGAATTAAAT |
| | | GCCATCAACACAACAGCTTCCCAAGATCCTGAAACTGAGCTCTATGCTGTTAGCAGCAAAC |
| | | TGGATTTCAATATGACAACCAACCACAGCTTCATGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGCAAATGGAATTTTTGTGATATGCTGCCTGACTT |
| | | ACTGCTTTGCCCCAAGATGCAGAGAGAGAAGGAGGAATGAGAGATTGAGAAGGGAAAGTGT |
| | | ACACCCTGTATGA |
| SEQ ID NO:156 | Round 2 CTLA4BP 2x4-g9 | ATGGGCCACACACGGAGGCAGGGAATATCACCATCCAAGTGTCCATACCTCAAGTTCTTTC |
| | | AGCTCTTGGTGCTGGCTTGTCTTTCTCATTTCTGTTCAGGTGTTATCCACGTGACCAAGGA |
| | | AGTGAAACAGGTGGCAACGCTGTCCTGTGGTCACAATGTTTCTGTTGAAGAGCTCGCACAA |

-continued

SEQUENCES

| SEQ ID | Clone ID Name | Sequence |
|---|---|---|
| | | ACTCGCATCTACTGGCAAAAGGATAAGAAAATGGTGCTGACTATGATGTCTGGGACATGA |
| | | ATATATGGCCCGAGTACAAGAACCAGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGATGCTTTCAAGCAGGAACACCTGGCTGAAGTGATGTTATCCGTCAAAGCTGACTTCC |
| | | CTACACCTAGTATATCTGACTTTGAAATTCCACCTTCTAACATTAGAAGGATAATTGCTC |
| | | AACCTCTGGAGGTTTTCCAGAGCCTCGCCTCGCCTGGATGGAAGATGGAGAAGAACTAAAT |
| | | GCCATCAGCACAACAGTTTCCCAAGATCCTGGAACTGAGCTCTGTACTGTTAGCAGCAAAC |
| | | TGCATTTCAATATGACAACCAACCACAGCTTCATGTGTCTCATCAGGTATGGACATTTAAG |
| | | AGTGAATCAGACCTTCAACTGGAATACACCCAAGCAAGAGCATTTTCCTGATAAQCTCCTC |
| | | CCATCCTGGGCCATTACCTTAATCTCAGTAAAGGGAATTTTTGTGATATGCTGCCTGACCT |
| | | ACTGCTTTGCCCCAAGAGGCAGAGAGAGAAAGAGCAATGGGAGACTGAGAAGGGAAAGTGT |
| | | ACACCCTGTATGA |
| SEQ ID NO:157 | Round 2 CTLA4BP 2x4-a6 | ATGGGCCACACACGGAGGCAGGGAACATCACCATCCAAGTGTCCATACCTCAAGTTCTTTC |
| | | AGCTCTTGGTGCTGGCTGGTCTTTCTCACTTCTGTTCAGGTGTTATCCACGTGACTAAGGA |
| | | AGTGAAAGAGTGGGACGCTGTCCTGTGGTCACAATGTTTCTGTTGAAGAGCTGGCACACAA |
| | | ACTCGCATCCACTGGCAAAAGGAGAAGAAAATGGTGCTGACTATGATGTCTGCGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATCAA |
| | | AAAGATGCTTTCAAGCGGGAACACCTGGCTGAAGTGATGTTATCCGTCAAAGCTGACTTCC |
| | | CTACACCTAGTATATCTGACTTTGAAATTCCACCTTCTAACATTAGAAGGATAATTTGCTC |
| | | AACCTCTGGAGGTTTTCCTGAGCCTCACCTCTTCTGGCTGGAAAATGGAGAAGAATTAAAT |
| | | GCCATCAGCACAACAGTTTCCCAAGATCCTGAAACTGAGCTCTATGCTGNTAGCAGCAAAC |
| | | TGGATTTCAATATGACAACCAACCACAGCTTCATCTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCCTAATCTCGGTAAATGGAATTTTTGTGATATGCTGCCCGACCT |
| | | ACTGCTTTGCCCCAAGGTGCAGACAGAGAAGGAGGAATGAGAGATTGAGAAGGGAAAGTGT |
| | | ATGCCCTGTATGA |
| SEQ ID NO:158 | Round 2 CTLA4BP 2x2-f3 | ATGGGCCACACACGGAGGCAGGGAATATCACCATCCAAGTGTCCATACCTCAAGTTCTTTC |
| | | AGCTCTTGGTGCTGGCTTGTCTTTCTCATTTCTGTTCAGGTGTTATCTACGTGACCAAGGA |
| | | AGTGAAAGAAGTGGCAACGCTGTCCTGTGGTCACAATGTTTCTGTTGAAGAGCTGGCACAA |
| | | ACTCGCATCTACTGGCAIAAGGAGAAGAAAATGGTGCTGATTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATAGGAGTGTGTTGTTCTGAAGTATGAA |
| | | AAAGATGCTTTCAAGCGGGAACACCTGGCTCAAGTGACGTTATCAGTCAAAGCTGACTTCC |
| | | CTACACCTAGTATATCTGACTTTGAAATTCCACCTTCTAACATTAGAAGGATAATTTGCTC |
| | | AACCTCTGGAGGTTTTCCTGAGCCTCACCTCTCCTGGCTGGAAAATGGAGAAGAATTAAAT |
| | | GCCATCAACACAACAGTTTCCCAAGATCCTGGAACTGAGCTCTATACTCTTAGCACCAAAC |

-continued

SEQUENCES

| SEQ ID | Clone ID Name | Sequence |
|---|---|---|
| | | TGGATTTCAATATGACAACCAACCACAGCTTCATGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGTAAATGGAATTTTTGTGATATGCTGCCTGACCT |
| | | ACTGCTTTGCCCCAAGATGCAGAGAGAGAAGGAGGAATGAGAGATTGAGAAGGGAAAGTGT |
| | | ATGCCCTGTATGA |
| SEQ ID NO:159 | Round 2 CTLA4BP 2x2-f12 | ATGGGCCACACACGGAGGCAGGGAACATCACCATCCAAGTGTCCATACCTCAAGTTCTTTC |
| | | AGCTCTTGGTGCTGGCTGGTCTTTCTCACTTCTGTTCAGGTGTTATCCACGTGACCAAGGA |
| | | AGTGAAAGAACTGGCAACACTGTCCTGTGGTCACAATGTTTCTGTTGAAGAGCTGGCACAA |
| | | ACTCCCATCCACTGGCAAGGACAAAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGGGTGTGTTGTTCTGGAGTATGAA |
| | | AAAGACGCTTTCAAGCGGGAACACCTGGCTGAAGTGATGTTATCCGTCAAAGCTGACTTCC |
| | | CTACACCTAGTATATCTGACTTTGAAATTCCACCTTCTAACATTAGAAGGATAATTTGCTC |
| | | AACCTCTGGAGGTTTTCCAGAGCCTCACCTCTCCTGGCTGGAAAATGGAGAAGAATTAAAT |
| | | GCCATCAACACAACAGTTTCCCAAGATCCTGAAACTGAGCTCTATGCTGTTAGCAGCAAAC |
| | | TGGATTTCAATATGACAACCAACCACAGCTTCATGTGTCTCATCAAGTATGGACATTTAAG |
| | | AGCGAATCAGACCTTCAACCTGGAATACACCCAGCAAGAGCATTTTCCTGATAACCTGCTC |
| | | CCATCCTGGGCCATTACCCTAATCTCAGTAAATCGAATTTTTGTGATATGCTGCCTGACCT |
| | | ACTGCTTTGCCCCAAGATGCAGAGAGAGAAGGAGGAATGAGAGATTGAGAAGGGAAAGTGT |
| | | ACGCCCTGTATGA |
| SEQ ID NO:160 | Round 2 CTLA4BP 2x1-g8 | ATGGGCTACACACGGAGGCAGGCAACATCACCATCCAAGTGTCCATACCTCAATTTCTTTC |
| | | AGCTCTTGGTGCTGGCTAGTCTTTCTCACTTCTGTTCAGGTGTTATCCACGTGACCAAGGA |
| | | AGTGAAAGAAGTGGCAACACTGTCCTGTGGTCACAATGTTTCTGTTGAAGAGCTGGCACAA |
| | | ACTCGCATCCACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCGTTGT |
| | | GATTCTGGCTCTCCGCCCATCTGACGAGGGCACATACGAGTGTGTTGTTCTGAAGTATGAA |
| | | AAAGACGCTTTCAAGCGGGAACACCTGGCTGAAGTGACGTTATCAGTCAAAGCTGACTTCC |
| | | CTACACCTAGTATAACTGACTTTGAAATTCCACCTTCTAACATTAGAAGGATAATTTGCTC |
| | | AACCTCTGGAGGTTTTCCTGAGCCTCACCTCTCCTGGCTGGAAAATGGAGAAGAATTAAAT |
| | | GCCATCAACACAACAGTTTCCCAAGATCCTGGAACTGAGCTCTATACTGTTAGCAGCAAAC |
| | | TGGATTTCAATATCACAACCAATCGCAGTTTTGTGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCCTAATCTCAGTAAATGGAATTTTTGTGATATCCTGCCTGACCT |
| | | ACTGCTTTGCCCCAAGATGCAGAGAGAGACAAAGAGCAATGAGAGACTCAGAAGGGAAAGTGT |
| | | ACGCCCTGTATGA |

-continued

SEQUENCES

| SEQ ID | Clone ID Name | Sequence |
|---|---|---|
| SEQ ID NO:161 | Round 2 CTLA4BP 2x1-f10 | ATGGGCTACACACGGAGGCAGGGAATATCACCATCCAAGTGTCCATACCTCAAGTTCTTTC<br>ACCTCTTGGTGCTGGCTGGTCTTTCTCACTTCTGTTCAGGTGTTATCCACGTGACCAAGGA<br>AGTGAAAGAAGTGGCAACGCTGTCCTGTGGTCACAATGTTTCTGTTGAAGAGCTGGCACAA<br>ACTCGCATCCACTCGCAAAAGGAGAAGAAAATGGTGCTGACTATGATGTCTGGGGACATGA<br>ATATATGGCCCGAGTACAAGAACCGGACCATCTTTGATATCACTAATAACCTCTCCATTGT<br>GATTCTGGCTCTGCGCCCATCTGAGGAGGGCACATACGAGTGTGTTGTTCTGAAGTATGAA<br>AAAGATCCTTTCAAGCGGGAACACCTGGCTGAAGTGATGTTATCCGTCAAAGCTGACTTCC<br>CTACACCTAGTATAACTGACTTTGAAATTCCACCTTCTAACATTAGAAGGATAATTTGCTC<br>AACCTCTGGAGGTTTTCCAGAGCCTCGCCTCGCCTGGATGGAAGATGGAGAAGAATTAAAT<br>GCCATCAACACAACAGTTTCCCAAGATCCTGGAACTGAGCTCTATGCTGTTAGCAGCAAAC<br>TGGATTTTAATATGACAACCAACCACAGCTTCATGTGTCTCATCAAGTATGGACATTTAAG<br>AGTGAATCAGACCTTCAACTGGAATACACCCAAGCAAGAGCATTTTCCTGATAACCTGCTC<br>CCATCCTGGGCCATTACCTTAATCTCAGTAAATGGAATTTCTGTGATATGCTGCCTGACCT<br>ACTGCTTTGCCCCAAGATGCAGAGAGAGAAGGAGGAATGAGAGATTGAGAAGGGAAAGTGT<br>ATGCCCTGTATGA |
| SEQ ID NO:162 | Round 2 CTLA4BP 2x1-c9 | ATGAGCCACACACGGAGGCAGGGAATATCACCATCCAAGTGTCCATACCTCAAGTTCTTTC<br>AGCTCTTGGTCCTGGCTGGTCTTTCTCACTTCTGTTCAGGTGTTATCCACGTGACCAAGGA<br>AGTGAAACAAGTGGCAACGCTGTCCTGTGGTCACAATGTTTCTGCTGAAGAGCTGGCACAA<br>ACTCCCATCTACTGGCAAAAGGAGAAGAAAATGGTGCTGACTATGATGTCTGGGGACATGA<br>ATATATGGCCCGAGTACAAGAACCGGACCATCTTTGATATCACTAATAACCTCTCCATTGT<br>GATTCTGCCTCTGCGCCCATCTGACGAGCGCACATACGAGTCTGTTGTTCTGGAGTATGAA<br>AAAGATGCTTTCAAGCGGGAACACCTGGCTGAAGTGATGTTATCCGTCAAAGCTGACTTCC<br>CTACACCTAGTATAACTGACTTTGAAATTCCAACTTCTAACATTAGAAGGATAATTTGCTC<br>AACCTCTGGAGGTTTTCCAGAGCCTCGCCTCGCCTGGATGGAAGATGGAGAAGAACTAAAT<br>GCCATCAGCACAACAGCTTCCCAAGATCCTGAAACTGAGCTCTATACTGTTAGCAGCAAAC<br>TGGATTTCAATATGACAACTAACCACAGCTTCATGTGTCTCATCAAGTATGGACATTTAAG<br>AGTGAATCAGACCTTCACCTGGAATACACCCAAGCAAGAGCATTTTCCTGATAACCTGCTC<br>CCATCCTGGGCCATTACCCTAATCTCAGTAAATGGAATTTTTGTGATATGCTGCCTGACCC<br>ACTGTTTTGCCCCAAGATGCAGAGAGAGAAGGAGGAATGAGAGATTGAGAAGGGAAAGTGT<br>ATGCCCTGTATGA |
| SEQ ID NO:163 | Round 2 CTLA4BP 2x1-h12 | ATGGGCCACACACGGAGGCAGGGAATATCACCATCCAAGTGTCCATACCTCAAGTTCTTTC<br>AGCTCTTGGTGCTGGCTGGTCTTTCTCACTTCTGTTCAGGTGTTATCCACGTGACCAAGGA<br>AGTGAAAGAAGTGGCAACGCTGTCCTGTGGTCTCAATGTTTCTGTTGAAGAGCTGGCACAA<br>ACTCGCATCCACTGGCAAAAGGAGAAGAAAATGGTGCTGACTATGATGTCTGGGGACATGA<br>ATATATGGCCCGAGTACAAGAACCGGACCATCTTTGATATCACTAATAACCTCTCCATTGT<br>GATTCTGGCTCTGCGCCCATCTGACGAGGGCACATACGAGTGTGTTGTTCTGAAGTATGAA<br>AAAGACGCTTTCAAGCGGGAACACCTGGCTGAAGTGATGTTATCCGTCAAAGCTGACTTCC |

| SEQ ID | Clone ID Name | Sequence |
|---|---|---|
| | | CTACACCTAGTATAACTGACTTTCAAATTCCACCTTCTAACATTAGAAGGATAATTTGCTC |
| | | AACCTCTGGAGGTTTTCCTGAGCCTCACCTCTCCTGGCTGGAAAATGCAGAAGAATTAAAT |
| | | GCCATCAACACAACAGTTTCCCAAGATCCTGGAACTGAGCTCTATACTGTTAGCAGCAAAC |
| | | TGGATTTCAATATGACAACCAACCACAGCTTCATGTGTCTCATCAAGTATGGACATTTAAG |
| | | AGTGAATCAGACCTTCAACTGGAATACACCCAAGCAACAGCATTTTCCTGATAACCTGCTC |
| | | CCATCCTGGGCCATTACCTTAATCTCAGCAAATGGAATTTTTGTGATATGCTGCCTGACCT |
| | | ACTGCTTTGCCCCAAGATGCAGAGAGAGAAAGAGCAATGAGAGACTGAGAAGGGAAAGTGT |
| | | ATGCCCTGTATGA |
| SEQ ID NO:164 | Round 2 CTLA4BP 2x1-e2 | ATGGGCTACACACCGAGGCAGGGAATATCACCATCCAAGTGTCCATACCTCAAGTTCTTTC |
| | | ACCTCTTGGTGCTGGCTTGTCTTTCTCATTTCTGTTCAGGTGTTATCCACGTGACCAAGGA |
| | | AGTGAAAGAAGTGGCAACACTGTCCTGTGGTCACAATGTTTCTGATGAAGAGCTGGCACAA |
| | | ACTCGCATCCACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATAGGAGTGTGTTGTTCTGAAGTATGAA |
| | | AAAGATGCTTTCAAGCGAGAACACCTGGCTGAAGTGACGTTATCAGTCAAAGCTGACTTCC |
| | | CTACACCTAGTATATCTGACTTTGAAATTCCACCTTCTAACATTAGAAGGATAATTTGCTC |
| | | AACCTCTGGAGGTTTTCCTGAGCCTCACCTCTCCTGGCTGGAAAATGGGGAAGAATTAAAT |
| | | GCCATCAACACAACAGTTTCCCAAGATCCTGGAACTGAGCTCTATACTGTTAGCAGCAAAC |
| | | TGGATTTCAATATGACAACCAACCACAGCTTCATGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTAGGCCATTACCTTAATCTCAGCAAATGGAATTTTTGTGATATGCTGCCTGACCT |
| | | ACTGCTTTGCCCCGAGATGCAGAGAGAGAAGGAGGAATGAGAGATTGAGAAGGGAAAGTAT |
| | | ACACCCTGTATGA |
| SEQ ID NO:165 | Round 2 CTLA4BP 2x1-c4 | ATGGGCTACACACGGAGGCAGGGAATATCACCATCCAAGTGTCCATACCTCAAGTTCTTTC |
| | | AGCTCTTGGTGCTGGCTGGTCTTTCTCATCTCTGTTCAGGTGTTATCCACGTGACTAAGGA |
| | | AGTGAAAGAAGTGGCAACGCTGCCCTGTGGTCACAATGTTTCTGTTGAAGAGCTGGCACAA |
| | | ACTCGCATCCACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGATGCTTTCAAGCGGGAACACCTGGCTGAAGTGATGTTATCCGTCAAAGCTGACTTCC |
| | | CTACACCTAGTATAACTGACTTTGAAATTCCACCTTCTAACATTAGAAGGATAATTTGCTC |
| | | AACCTCTGCAGGTTTTCCAGAGCCTCACCTCTTCTGGCTGGAAAATGGAGAAGAATTAAAT |
| | | GCCATCAACACAACAGTTTCCCAAGATCCTGGAACTGAGCTCTATGCTGTTAGCAGCAAAC |
| | | TGGATTTCAATATGACAACCAACCACAACTTCATGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGTAAATGGAATTTTTGTGATATGCTGCCTGACCT |

-continued

SEQUENCES

| SEQ ID | Clone ID Name | Sequence |
|---|---|---|
| | | ACTGCTTTGCCCCAAGATGCAGAGAGAGAAGGAGGAATGAGAGATTGAGAAGGGAAAGTGT |
| | | ACGCCCTGTATGA |
| SEQ ID NO:166 | Round 2 CTLA4BP 2x1-b12 | ATGGGCCACACACGGAGGCAGGGGATATCACCATCCAAGTGTCCATACCTCAAGTTCTTTC |
| | | AGCTCTTGGTGCTGGCTGGTCTTTCTCATCTCTGTTCAGGTGTTATCCACATGACTAAGGA |
| | | AGTGAAAGAAGTCGCAACACTGTCCTGTGGTCACAATGTTTCTGTTGAAGAGCTGCCACAA |
| | | ACTCGCATCTACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGCTCTGAAGTATGAA |
| | | AAAGATGCTTTCAAGCAGGAACACCTGGCTGAAGTGACGTTATCAGTCAAAGCTGACTTCC |
| | | CTACACCTAGTATATCTGACTTTGAAATTCCACCTTCTAACATTAGAAGGATAATTTGCTC |
| | | AACCTCTGGAGGTTTTCCAGAGCCTCGCCTCGCCTGGATGGAAGATGGAGAAGAATTAAAT |
| | | GCCATCAACACAACAGTTTCCCAAGATCCTGAAACTGAGCTCTATACTGTTAGCAGCAAAC |
| | | TGGATTTCAATATGACAGCCAACCACAGCTTCATGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGTAAATGGAATTTTTGTGATATGCTGCCTGACCT |
| | | ACTGCTTTGCCCCAAGATGCAGAGAGAGAAGGAGGAATGAGAGATTGAGAAGGGAAAGTGT |
| | | ATGCCCTGTATGA |
| SEQ ID NO:167 | Round 2 CTLA4BP 2x2-f1 | ATGGGCCACACACGGAGGCAGGGAATATCACCATCCAAGTGTCCATACCTCAAGTTCTTTC |
| | | AGCTCTTGGGGCTGGCTTGTCTTTCTCATTTCTGTTCAGGTGTTATCCACGTGACCAAGGA |
| | | AGTGAAAGAAGTGGCAACACTGTCCTGTGGTCACAATGTTTCTGTTGAAGAGCTGGCACAA |
| | | ACTCGCATCCACTGGCAAAAGGAGAAGAAAATGGTGCTGACTATGATGTCTGGGGACATGA |
| | | ATATATCGCCCGAQTACAAGAACCGGACCATCTTTGATATCACTAATAACCTCTCCATTGT |
| | | GATTCTGCCTCTGCGCCTATCTGACGAGGGCACATACGAGTGTGTTGTTCTGAAGTATGAA |
| | | AAGGACGCTTTCAAGCGGGAACACCTGGCTGAAGTGACGTTATCAGTCAAAGCTGACTTCC |
| | | CTACACCTAGTATATCTCACTTTGAAATTCCAACTTCTAACATTAGAAGGATAATTTGCTC |
| | | AACCTCTGGAGGTTTTCCAGAGCCTCACCTCTTCTGGCTGGAAAATGGGGAAGAATTAAAT |
| | | GCCATCAACACAACAGCTTCCCAAGATCCTGAAACTGAGCTCTATACTGTTAGCAGCAAAC |
| | | TGGATTTCAATATGACAACCAATCGCAGTTTTGTGTGTCTCATCAAGTATCGACATTTAAG |
| | | AGTGAATCAGACCTTCAACTGGAATACACCCAAGCAAGAGCATTTTCCTGATAACCTACTC |
| | | CCATCCTGGGCCATTACCTTAATCTCAGTAAATGGAATTTTCGTGATATGCTGCCTGACCT |
| | | ACTGCTTTGCCCCAAGATGCAGAGAGAGAAGCAGGAATGAGAGATTGAGAAGGGAAAGTGT |
| | | ACGCCCTGTATGA |
| SEQ ID NO:168 | Round 2 CTLA4BP 5x4-h1 | ATGAGCCACACACGGAGGCAGGGAATATCACCATCCAAGTGTCCATACCTCAAGTTCTTTC |
| | | AGCTCTTGGTGCTGGCTTGTCTTTCTCATTTCTGTTCAGGTGTTATCCACGTGACCAAGGA |
| | | AGTGAAAGAAGTGGCAACGCTGTCCTGTGGTCACACTCTTTCTGTTGAAGAGCTGGCACAA |
| | | ACTCGCATCCACTGGCAAAAGGAGAAGAAAATGGTGCTGACTATGATCTCTGGGGACATGA |
| | | ATATATGGCCCGAGTACAAGAACCGGACCATCTTTGATATCACTAATAACCTCTCCATTGT |

-continued

SEQUENCES

| SEQ ID | Clone ID Name | Sequence |
|---|---|---|
| | | GATTCTGGCTCTGCGCCCATCTGACGAGGGCACATACGAGTGTGTTGTTCTGAAGTATGAA |
| | | AAAGATGCTTTCAAGCGGAAACACCTGGCTGAAGTGATGTTATCCGTCAAAGCTGACTTCC |
| | | CTACACCTAGTATATCTGACTTTGAAATTCCAACTTCTAATATTAGAAGGATAATTTGCTC |
| | | AACCTCTGGAGGTTTTCCTGAGCCTCACCTCTTCTGGCTGGAAAATGGAGAAGAATTAAAT |
| | | GCCATCAACACAACAGCTTCCCAAGATCCTGAAACTGAGCTCTATACTGTTAGCAGCAAAC |
| | | TGGATTTCAATATGACAACCAATCGCAGTTTTGTGTGTCTCATCAAGTATGGACATTTAAG |
| | | AGTGAATCAGACCTTCAACTGGAATACACCCAAGCAAGAGCATTTTCCTAATAACCTGCTC |
| | | CCATCCTGGGCCATTACCTTAATCTCAGTAAATCGAATTTTTGTGATATGCTGCCTGACCT |
| | | ACTGCTTTGCCCCAAGATGCAGAGAGAGGAGAAGGAATGAGACACTGAGAAGGGAAAGTGT |
| | | ACACCCTGTATGA |
| SEQ ID NO:169 | Round 2 CTLA4BP 5x4-a1 | ATGGGCCACACACGGAGGCAGGGAACATCACCATCCAAGTGTCCATACCTCAAGTTCTTTC |
| | | AGCTCTTGGTGCTGGCTGGTCTTTCTCACTTCTGTTCAGGTGTTATCCACGTGACCAAGGA |
| | | AGTGAAAGAAGTGGCAACGCTGTCCTGTGGTCACAATGTTTCTGTTGAAGAGCTGGCACAA |
| | | ACTCGCATCTACTGGCAAAAGGAGAAGAAAATGGTGCTGACTATGATGTCTGGGGACATGA |
| | | ATATATGGCCCGAGCACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGACGCTTTCAAGCGGGAACACCTGGCTGAAGTGACGTTATCAGTCAAAGCTGACTTCC |
| | | CTACACCTAGTATAACTGACTTTGAAATTCCAACTTCTAATATTAGAAGGATAATTTGCTC |
| | | AACCTCTGGAGGTTTTCCAGAGCCTCACCTCTCCTGGCTCGAAAATCGAGAAGAATTAAAT |
| | | GCCATCAACACAACAGTTTCCCAAGATCCTGGAACTGAGCTCTATACTGTTAGCAGCAAAC |
| | | TGGATTTCAATATGACAACCAATCGCAGTTTTGTGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCTTAATCTCAGTAAATGGAATTTTTGTGATATGCTGCCTGACCT |
| | | ACTGCTTTGCCCCAAGATGCAGGGAGAGAAGGAGGAATGAGAGATTGAGAAGGGAAAGTGT |
| | | ACGCCCTGTATGA |
| SEQ ID NO:170 | Round 2 CTLA4BP 5x2-f3 | ATGAGCCACACACGGAGGCAGGGAATATCACCATCCAAGTGTCCATACCTCAAGTTCTTTC |
| | | AGCTCTTGGTGCTGGCTAGTCTTTCTCACTTCTGTTCAGGTGTTATCCACGTGACCAAGGA |
| | | AGTGAAAGAAGTGGCAACGCTGTCCTGTGGTCACAATGTTTCTGTTGAAGAGCTGGCACAA |
| | | ACTCGCATCTACTGGCAAAAGGAGAAGAAAATGGTGCTGACTATGATGCCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAGGTATGAA |
| | | AAAGATGCTTTCAAGCGGGAACACCTGGCTGAAGTGACGTTATCAGTCAAAGCTGACTTCC |
| | | CTACACCTAGTATATCTGACTTTGAAATTCCAACTTCTAATATTAGAAGGATAATTTGCTC |
| | | AACCTCCGGAGGTTTTCCTGAGCCTCACCTCTCCTGGCTGGAAAATGGCGAAGAATTAAAT |
| | | GCCATCAACACAACAGCTTCCCAAGATCCTGAAACTGAGCTCTATACTGTTAGCAGCAAAC |
| | | TGGATTTCAATATGACAACCAATCGCAGTTTTGTGTGTCTCATCAAGTATGGACATTTAAG |
| | | AGTGAATCAGACCTTCAACTGGAATACACCCAAGCAAGAGCATTTTCCTGATAACCTGCTC |

-continued

SEQUENCES

| SEQ ID | Clone ID Name | Sequence |
|---|---|---|
| | | CCATCCTGGGCCATTACCTTAATCTCAGCAAATGGAATTTTTGTGATATGCTGCCTGACCC |
| | | ACTGCTTCGCCCCAAGATGCAGAGAGAGAAAGAGCAATGAGAGACTGAGAAGGGAAAGTCT |
| | | ACGCCCTGTATAG |
| SEQ ID NO:171 | Round 2 CTLA4BP 5x2-e12 | ATGAGCCACACACGGAGGCAGGGAATATCACCATCCAAGTGTCCGTACCTCAAGTTCTTTC |
| | | AGCTCTTGGTGCTGGCTGGTCTTTCTCATTTCTGTTCAGGTGTTATCCACGTGACTAAGGA |
| | | AGTGAAAGAAGTGGCAACACTGTCCTGTGGTCACAATGTTTCTGTTGAAGAGCTGGCACAA |
| | | ACTCGCATCCACTGGCAAAAGGAGAAGAAAATGGTGCTGACTATGATGTCTGGGGCATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGACGCTTTCAAGCGGGAACACCTAGCTGAAGTGACGTTATCAGTCAAAGCTGACTTCC |
| | | CTACACCTAGTATATCTGACTTTGAAATTCCAACTTCTAATATTAGAAGGATAATTTGCTC |
| | | AACCTCTGGAGGTTTTCCAGAGCCTCACCTCTCCTGGCTGGAAAATGGAGAAGAATTAAAT |
| | | GCCATCAGCACAACAGTTTCCCAAGATCCTGGAACTGAGCTCTATGCTGTTAGCAGCAAAC |
| | | TGGATTTCAATATGACAACCAATCGCAGTTTTGTGTGTCTCATCAAGTATGGACATTTAAG |
| | | AGTGAATCAGACCTTCAACTGGAATACAACCAAGCAAGAGCATTTTCCTGATAACCTGCTC |
| | | CCATCCTGGGCCATTACCCTAATCTCAGTAAATGGAATTTTTGTGATATGCTGCCTGACCT |
| | | ACTGCTTTGCCCCAAGATGCAGAGAGAGAAGGAGGAATGAGAGATTGAGAAGGGAAAGTGT |
| | | ACGCCCTGTATAG |
| SEQ ID NO:172 | Round 2 CTLA4BP 2x4-h11 | ATGGGCTACACACGGAGGCAGGGAACATCACCATCCAAGTGTCCATACCTCAAGTTCTTTC |
| | | AGCTCTTGGTGCTGGCTTGTCTTTCTCATTTCTGTTCAGGTGTTATCCACGTGACTAAGGA |
| | | AGTGAAAGAAGTGGCAACACTGTCCTGTGGTCACAATGTTTCTGTTGAAGAGCTGGCACAA |
| | | ACTCGCATCTACTGGCAAAAGGAGAAGAAAATGGTGCTGACTATGATGTCTGGGGACATGA |
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGGAGTATGAA |
| | | AAAGACGCTTTCAAGCGGGAACACCTGGCTGAAGTGATGTTATCCGTCAAAGCTGACTTCC |
| | | CTACACCTAGTATATCTGACTTTGAAATTCCACCTTCTAACATTAGAAGGATAATTTGCTC |
| | | AACCTCTGGAGGTTTTCCTCAGCCTCACCTCTCCTGGCTGGAAAATGGAGAAGAATTAAAT |
| | | GCCATCAACACAACAGTTTCCCAAGATCCTGGAACTGAGCTCTATGCTGTTAGCAGCAAAC |
| | | TGGATTTCAATATGACAACCAACCACAGCTTCATGTGTCTCATCAAGTATGGACATTTAAG |
| | | AGTGAATCAGACCTTCAACTGGAATACACCCAAGCAAGAGCATTTTCCTGATAACCTGCTC |
| | | CCATCCTGGGCCATTACCCTAATCTCAGTAAATGGAATTTTTGTGATATGCTGCCTGGCCT |
| | | ACTGCTTTGCCCCAAGATGCAGAGGGAGAAGGAGGAATGAGAGATTGAGAAGGGAAAGTGT |
| | | ACGCCCTGTATGA |
| SEQ ID NO:173 | Round 2 CTLA4BP 2x3-h2 | ATGGGCCACACACGGAGGCAGGGAACATCACCATCCAAGTGTCCGTACCTCAATTTCTTTC |
| | | AGCTCTTGGTGCTGGCTTGTCTTTCTCACTTCTGTTCAGGTGTTATCCACGTGACTAAGGA |
| | | AGTGAAAGAAGTGGCAACGCTGTCCTGTGGTCACAATGTTTCTGTTGAAGAGCTGGCACAA |
| | | ACTCGCATCTACTGGCAAAAGGAGAAGAAAATGGTGCTGACTATGATGTCTGGGGACATGA |

SEQUENCES

| SEQ ID | Clone ID Name | Sequence |
|---|---|---|
| | | ATATATGGCCCGAGTACAAGAACCGGACCATCTTTGATATCACTAATAACCTCTCCATTGT |
| | | GATTCTGGCTCTGCGCCCATCTGACGAGGGCACATACGAGTGTGTTGTTCTGAAGTATGAA |
| | | AAAGATGCTTTCAAGCGAGAACACCTGGCTGAAGTGATGTTATCCGTCAAAGCTGACTTCC |
| | | CTACACCTAGTATATCTGACTTTGAAATTCCACCTTCTAACATTAGAAGGATAATTTGCTC |
| | | AACCCCTGGAGGTTTTCCAGAGCCTCGCCTCGCCTGGATGGAAGATGGGGAAGAACTAAAT |
| | | GCCATCAGCACAACAGTTTCCCAAGATCCTGGAACTGAGCTCTATGCTGTTAGCAGCAAAC |
| | | TGGATTTCAATATGACAACCAACCACAGCTTCATGTGTCTCATCAAGTATGGACATTTAAG |
| | | AGTGAATCAGACCTTCAACTGGAATACAACCAAGCAAGAGCATTTTCCTGATAACCTGCTC |
| | | CCATCCTGGGCCATTACCCTAATCTCAGTAAAGGGAATTTTTGTGATATGCTGCCTGACCT |
| | | ACTGCTTTGCCCCAAGATGGAGAGAGAGAAAGAGCAATGAGAGACTGAGAAGGGAAAGTGT |
| | | ACGCCCTGTATAG |
| SEQ ID NO:174 | Round 2 CD28A12-5 | MGHTMKWGSLPPKRPCLWLSQLLVLTGLFYFCSGITPKSVTKRVKETVMLSCDYNTSTEEL TSLRIYWRKDSKNXLAILPGKVQVWPEYKNRTITDMNDNLRIVILALRLSDSGTYTCVIQK PDLKGAYKLEHLTSVRLMIRADFPVPTINDLGNPSPNIRRLICSTSGCFPRPHLYWLENGE ELNATNTTVSQDPGTELYMISSELDFNVTNNHSIVCLIKYGELLVSQIFPWSKPKQEPPID QLPFWVIIPVSGALVLTAVVLYCLACRWJARWKRTRRNEETVGTERLSPIYLGSAQSSG |
| SEQ ID NO:175 | Round 2 CD28A4-5* | MCHTMKWGSLPPKCPCLWLSQLLVLTCLFYFCSGITPKSVTKRVKETVMLSCDYNTSTEEL TSLRIYWQKDSKNVLAILPGKVQVWPEYKNRTITDMNDNPRIVILALRLSDSGTYTCVIQK PVLKGAYKLEHLTSVRLNIRADFPVPTINDLGNPSPNIRRLICSTSGGFPRPHLYWLENGE ELNATNTTLSQDPETKLYMISSELDFNVTNNHSIVCLIKYGELSVSQIFPWSKPKQEPPID QLPFWVIIPVSGALVLTAVVLYCLACRHVARWKRTRRNEETVGTERLSPIYLGSAQSSG |
| SEQ ID NO:176 | Round 2 CD28A4-9 | MGHTNKWGSLPPKRPCLWLSQLLVLTGLFYFCSGITPKSVTKRVKETVNLSCDYNTSTEKL TSLRIYWQKDSKMVLAILPCKVQVWPEYKNRTITDMNDNPRIVTLALRLSDSGTYTCVIQK PVLKGAYKLEHLTSVRLMIRADFPVPTINDLGNPSPNERRLICSTSGGFPRPHLYWLENGE ELNATNTTVSQDPETKLYMISSELDFNVTNNHSIVCLIKYGELSVSQIFPWSKPKQEPPID QLPFWVIIPVSGALVLTAVVLYCPACRHVARWKRTRRNEETVGTERLSPIYLGSAQSRAEV PSLSX |
| SEQ ID NO:177 | Round 2 Cd28A6-9 | MGHTNKWGSLPPKRPCLWLSQLLVLTGLFYFCSGITPKSVTKRVKETVMLSCDYNTSTEEL TSLRIYWQKDSKNVLAILPGKVQVWPEYKNRTITDMNDNPRIVILALRLSDSGTYTCVIQK PVLKGAYKLEHLASVRLMIRADFPVPTINDLGNPSPNIRRLICSTSGGFPRPHLYWLENGE ELNATNTTVSQDPGTELYNISSELDFNVTNNHSIVCLIKYGELSVSQIFPWSKPKQEPPID QLPFLVIIPVSGALVLTAVVLYCLACRHVARWKRTRRNEETVGTERLSPIYLGSAQSSC |
| SEQ ID NO:178 | Round 2 CD28A6-1 | MGHTMKWGSLPPKRPCLWLPQLLVLTGLFYFCSGITPKSVTKRVKETVMLSCDYNTSTEEL TSLRIYWQKDSKNVLAILPGKVQVWPEYKNRTITDMNDNPRIVILALRLSDSGTYTCVIQK PVLKGAYKLEHLASVRLMIRADFPVPTINDLGNPSPNIRRLICSTSGGFPRPHLYWLENGE ELNATNTTVSQDPETKLYMISSELDFNVTNKHSIVCLIKYGELSVSQIFPWSKPKQEPPID QLPFRVIIPVSGALVLTAIVLYCLACRHVARWKRTRRNEETVGTERLSPIYLGSAQSSG |

-continued

SEQUENCES

| SEQ ID | Clone ID Name | Sequence |
|---|---|---|
| SEQ ID NO:179 | Round 2 CD28A8-4 | MGHTMKWGSLPPKRPCLWLSQLLVLTGLFYFCSGITPKSVTKRVKETVMLSCDYNTSTEEL TSLRIYWQKDSKMVLAILPGKVQVWPEYKNRTITDNNDNPRIVILALRLSDSGTYTCVIQK PVLKGAYKLEHLTSVRLMIRADFPVPTINDLGNPSPNIRRLICSTSGGFPRPHLYWLENGE ELNATNTTVSQDPGTELYMISSELDFNVTNNHSIVCLIKYGELSVSQIFPWSKPKQEPPID QLPFWVIIPVSGALVLTAVVLYCLACRHVARWKRTRRNEETVGTERLSPIYLGSAQSSG |
| SEQ ID NO:180 | Round 2 CD28A8-6 | MGHTMKWGSLPPKRPCLWLSQLLVLTGLFYFCSGITPKSVTKRVKETVMPSCDYSTSTEEL TSLRIYWQKDSKNVLAILPGKVQVWPEYKNRTITDMNDNPRIVILALRLSDSGTYTCVVQK NENGSFRREHLTSVTLSIRADFPVPSITDIGHPAPNVKRIRCSASGGFPEPRLAWNEDGEE LNAVNTTVDQDLDTELYSVSSELDFNVTNNHSIVCLIKYCELSVSQIFPWSKPKQEPPIDQ LPFWVIIPVSGALVLTAVVLYCLACRHVARWKRTRRNEETVGTERLSPIYLGSAQSSG |
| SEQ ID NO:181 | Round 2 CD28B2-8 | MGHTMKWGSLPPKRPCLWLSQLLVLTGLFYFCSGITPKSVTKRVKETVMLSCDYNTSTEEL TSLRIYWQKDSKMVLAILPCKVQVWPEYKNRTITDMNDNPRIVILALRLSDKGTYTCVIQK PVLKCAYKLEHLASVRLMIRADFPVPTINDLGNPSPNIRRLICSTSGGFPRPHLYWLENGE ELNATNTTVSQDPGTELYMISSELDFNVTNNHSIVCLIKYGELSVSQIFPWSKPKQEPPID QLPFWVIIPVSGALVLTAVVLYCLACRHVARWKRTRRNEETVGTERLSPIYLGSAQSSG |
| SEQ ID NO:182 | Round 2 CD28B4-3 | MGHTNKWGSLPPKRPCLWLSQLLVLTGLFYFCSCITPKSVTKRVKETVNLSCDYNTSTEEL TSLRIYWQKDSKMVLAILPGKVQVWPEYKNRTITDNNDNPRIVILALRLSDSGTYTCVIQK PVLKGAYKLEHLTSVRLMIRADFPVPTINDLGNPSPNIRRLICSTSGGFPRPHLYWLENGE ELNATNTTLSQDPETKLYNISSELDFNNTSNHSFLCLVKYGDLTVSQTFYWQESKPTPSAN QHLTWTIIIPVSAFGISVIIAVILTCLTCRNAAIRRQRRENEVEMQSCSQSP |
| SEQ ID NO:183 | Round 2 CD28B6-3 | MGHTMKWGSLPPKRPCLWLSQLLVLTGLFYFCSGITPKSVTKRVKETVMLSCDYNTSTEEL TSLRIYWQKDSKNVLAILPGKVQVWPEYKNRTITDMNDNPRIVILALRLSDSGTYTCVIQK PDLKGAYKLEHLTSVRLMIRADFPVPTINDLGNPSPNIRRLICSTSGGFPRPHLYWLENGE ELNATNTTLSQDPETKLYMISSELDFNNTSNHSPLCLVKYGDLTVSQTFYWQESKPTPSAN QHLTWTIIIPVSAFGISVIIAVILTCLTCRNAAIRRQRRENEVKNQSCSQSF |
| SEQ ID NO:184 | Round 2 CD28B6-6 | MGHTMKWGSLPPKRPCLWLSQLLVLTGLFYFCSGITPKSVTKRVKETVMLSCDYSTSTEEL TSLRIYWQKDSKNVLAILPGKVQVWPEYKNRTITDMNDNPRIVILALRLSDKGTYTCVIQK PVLKGAYKLEHLTSVTLSIRADFPVPSITDIGHPAPNVKRIRCSASGGFPEPRLAWMEDGE ELNAVNTTVDQDLDTELYSVSSELDFNATNNHSIVCLIKYGELSVSQIFPWSKPKQEPPID QLPFWVIVPVSGALVLTAVVLYCLACRHVAR |
| SEQ ID NO:185 | Round 2 CD28B8-5* | MGHTMKWGSLPPKRPCLWLSQLLVLTGLFYFCSGITPKSVTKRVKETVNLSCDYSTSTEEL TSLRIYWQKDSKNVLAILPGKVQVWPEYKNRTITDMNDNPRIVILALRLSDSGTYTCVIQK PVLKGAYKLEHLTSVRLMIRADFPVPTINDLGNPSPNIRRLICSTSGGFPRPHLYWLENCE ELNATNTTLSQDPGTELYMISSELDFNVTNNHSIVCLIKYGELSVSQIFPWSKPKQEPPID QLPFWVIIPVSGALVLTAVVLYCLACRHVARWKRTRRNEETVGTERLSPIYLGSAQSSG |
| SEQ ID NO:186 | Round 2 CD28C11-5 | MCHTMKWGSLPPKRPCLWPSQLLVLTGLFYFCSGITPKSVTKRVKETVMLSCDYNTSTEEL TSLRIYWQKDSKMVLAILPCKVQVWPEYKNRTITDHNDNPRIVILALRLSDSGTYTCVIQK |

| SEQ ID | Clone ID Name | Sequence |
|---|---|---|
| | | PVLKCAYKLEHLTSVRLMIRADFPVPTINDLGNPSPNIRRLICSTSCGFPRPHLYWLENCE |
| | | ELNATNTTVSQDPCTELYMISSELDFNVTNNHSIACLIKYGELSVSQIFPWSKPKQEPPID |
| | | QLPFWVIIPVSGALVLTAVVLYCLACRHVARWKRTRRNEETVGTERLSPIYLGSAQSSG |
| SEQ ID NO:187 | Round 2 CD28C6-1 | MCHTMKWGSLPPKRPCLWLSQLLVLTGLFYFCSGITPKSVTKRVKETVMLSCDYSTSTEEL TSLRIYWQKDSKNVLAILPGKVQVWPEYKNRTITDNNDNPRIVILALRLSDSGTYTCVIQK PVLKGAYKLEHLASVRLMIPADFPVPTINDLGNPSPNIRRLICSTSGGFPRPHLYWLENGE ELNATNTTVSQDPCTELYMISSELDFNVTNNHSIVCLIKYGELSVSQIFPWSKPKQEPPID QLPFWVIIPVSGALVLTAVVLYCLACRHGARWKRTRRNEETVGTERLSPIYLCSAQSSG |
| SEQ ID NO:188 | Round 2 CD28C7-3 | MGHTNKWGSLPPKRPCLWLSQLLVLTCLPYFCSGITPKSVTKRVKETVMLSCDYSTSTEEL TSLRIYWQKDSKMVLAILPGKVQVWPEYKNRTITDMNDNPRIVILALRLSDSGTYTCVIQK PDLKGAYKLEHLTSVRLMIRADFPVPSITDIGHPAPNVKRIRCSASGDFPEPRLAWNEDGE ELNAVNTTVDQDLDTELYSVSSELDFNVTNNHSIVCLIKYGELSVSQIFPWSKPKQEPPID QLPFWVIIPVSGALVLTAVVLYCLACRHVARWKRTRRNEETVGTERLSPIYLGSAQSSG |
| SEQ ID NO:189 | Round 2 CD28C8-6 | MGHTNKWGSLPPKRPCLWLSQLLVLTGLFYFCSGITPKSVTKRVKETVMLSCDYNTSTEEL TSLRIYWQKDSKMVLAILPGKVQVWPEYKNRTITDNNDNPRTVILALRLSDSGTYTCVIQK PVLKGAYKLEHLASVRLNIRADFPVPTINDLGNPSPNIRRLICSTSGGFPRPHLYWLENGE ELNATNTTVSQDPGTELYMISSELGFNVTNNHSIVCLIKYGELSVSQIFPWSKPKQEPPID QLPFWVIIPVSGALVLTAWLYCLACRHVARWKRTRRNEETVGTERLSPIYLCSAQSSG |
| SEQ ID NO:190 | Round 2 CD28C9-5* | MGHTMKWGSLPPKRPCLWLSQLLVLTGLFYFCSGITPKSVTKRVKETVNLSCDYSTSTEEL TSLRIYWQKDSK1AVLAILPGKVQVPEYKNRTITDNNDNPRIVILALRLSDSGTYTCVIQK PVLKGAYKLEHLASVRLNIRADFPVPTINDLGNPSPNIRRLICSTSGGFPRPRLYWLENGE ELNATNTTVSQDPGTELYNISSEIDFNVTNNHSIVCLIKYGELSVSQIFPWSKPKQEPPID QLPFWVIIPVSGALVLTAVVLYCLACRHVARXKRTRRNEETVGTERLSPIYLGSAQSSG |
| SEQ ID NO:191 | Round 2 CD28C2-4 | MGHTLRPGTPLPRCLHLKLCLLLALAGLHFSSGISQVTKSVKEMAALSCDYNISIDELARM RIYWQKDQQNVLSIISGQVEVWPEYKNRTITDMNDNPRIVILALRLSDSGTYTCVIQKPVL KCAYKPEHLASVRLMTRADFPVPTINDLGNPSPNIRRLICSTSGGFPRPHLYWLENCEELN ATNTTLSQDPETKLYMISSELDFNMTSNNSFLCLVKYGDLTVSQTFYWQESKPTPSANQHL TWTIITPVSAFGISVIIAVILTCLTCRNAAIRRQRRENEVEMQSCSQSP |
| SEQ ID NO:192 | Round 2 CD28D2-3 | MGHTMKWGSLPPKRPCLWLSQLLVLTGLFYFCSGITPKSVTKRVKETVMLSCDYNTSTEEL TSLRIYWQKDSKMVLAILPGKVQVWPEYKNRTITDHNDNPRIVIQALRLSDSCTYTCVIQK PVLKGAYKLEHLASVRLMIPADFPVPTDLCNPSPNIRRLICSTSGGFPRPHLYWLENGEEL NATNTTVSQDPGTELYMISSELDFNVTNNHSIVCLIKYGELSVSQIFPWSKPKQEPPIDQL PFWVIIPVSGALVLTAWLYCLACRHVARWKRTRRNEETVGTERLSPIYLGSAQSSG |
| SEQ ID NO:193 | Round 2 CD28D2-9 | MGHTMKWGSLPPKRPCLWLSQLLVLTGLFYFCSGTTPKSVTKRVKETVMLSCDYNTSTEEL TSLRIYWQKDSKNVLAILPGKVQVWPEYKNRTITDMNDNPRIVILALRLSDSGTYTCVIQK PVLKGAYKLEHLTSVRLMIRADFPVPTINDLGNPSPNIRRLICSTSGGFPRPHLYWLENGE |

-continued

SEQUENCES

| SEQ ID | Clone ID Name | Sequence |
|---|---|---|
| | | ELNATNTTLSQDPETELYMISSELDFNVTNNHSIVCLThYGELSVSQIFPWSKPKQEPPID |
| | | QLPFWVIIPVSGALVLTAWLYCLACRHVARWKRTRRNEETVGTERLSPIYLGSAQSSG |
| SEQ ID NO:194 | Round 2 CD28D8-9 | MGHTMKWGSLPPKRPCLWLSQLLVLTGLFYFCSCITPKSVTKRVKETVMLSCDYSTSTEEL TSLRIYWQKDSKMVLAILPGKVQVWPEYKNRTITDMNDNPRIVILALRLSDSGTYTCVIQK PVLKGAYKLEHLTSVRLMIRADFPVPTINDLGNPSPNIRRLICSTSGGFPRPHLYWLENGE ELNATNTTVSQDPGTELYMISSELDFNVTNNHSIVCLIKYGELSVSQIPPWSKPKQEPPID QLPPWVIIPVSGALVLTAWLYCLACRHVARWKRTRRNEETVGTERLSPIYLGSAQSSG |
| SEQ ID NO:195 | Round 2 CD28D11-1 | MGHTMKWGSLPPKRPCLWLSQLLVLTGLFYFCSGITPKSVTKRVKETVNLSCDYNTSTEEL TSLRIYWQKDSKMVLAILPGKVQVWPEYKNRTITDMNDNPRIVILALRLSDSGTYTCVVQK NENGSFRREHLTSVTLSIRADFPVPSITDIGHPAPNVKRIRCSASGDFPEPRLAWNEDGEE LNAVNTTVDQDLDTELYSVSSELDFNVTNNHSIVCLIKYGELSVSQIFPWSKPKQEPPIDQ LPFWVIILVSGALVLTAVVLYCLACRHVARWKRTRRNEETVGTERLSPIYLGSAQSSG |
| SEQ ID NO:196 | Round 2 CD28D12-5 | NGHTMKWGSLPPKRPCLWLSQLLVLTGLFYFCSGITPKSVTKRVKETVMLSCDYSTSTEEL TSLRIYWQKDSKMVLAILPGKVQVWPEYYNRTITDMNDNPRIVILALRLSDSGTYTCVIQK PVLKGAYKLEHLASVRLMIRADFPVPSITDIGHPAPNVKRIRCSASGDFPEPRLAWMEDGE ELNAVNTTVLDTELYSVSSELDFNVTNNHSIVCLIKYGELSVSQIFPWSKPKQEPPIDQLP FWVIIPVSGALVLTAVVLYCLACRHVARWKRTRRNEETVGTERLSPIYLCSAQPSG |
| SEQ ID NO:197 | Round 2 CD28E10-6 | MGHTMEWGSLPPKRPCLWLSQLLVLTGLFYECSGITPKSVTKRVKETVMLSCDyNTSTEEL TSLRIYWQKDSKMVLAILPGKVQVWPEYKNRTITDMNDNPRIVILALRLSDSGTYTCVIQK PVLKGAYKLEHLASVRLNIRADFPVPTINDLGNPSPNIRRLICSTSGGEPRPHLYWLENGE ELNATNTTLSQDPETETLYMISSELDFNVTNNHSIVCLIKYGELSVSQIFPWSKPKQEPPID QLPFWVIIPVSCALVLTAVVLYCLACRHVARWKRTRRNEETVGTERLSPIYLGSAQSSG |
| SEQ ID NO:198 | Round 2 CD28F7-2 | MGHTMKWGSLPPKRPCLWLSQLLVLTGLFYFCSGITPKSVTKRVKETVMLSCDYSTSTEEL TSLRIYWQKDSKMVLAILPGKVQVWPEYKNRTITDMNDNPRIVILALRLSDSGTYTCVIQK PVLKGAYKLEHLASVRLMIPADFPVPTINDLGNPSPNIRRLICSTSGGFPEPRLAWMEDGE ELNAVNTTVDQDLDTELYSVSSELDFNVTNNHSIVCLIKYGELSVSQIFPWSKPKQEPPID QLPFWVIIPVSGALVLTAVVLYCLACRHVARWKRTRRNEETVGTERLSPIYLGSAQSSG |
| SEQ ID NO:199 | Round 2 CD28F8-4 | MGHTMKWGSLPPKRPCLWLSQLLVLTGLFYFCSCITPKSVTKRVKETVNLSCDYSTSTEEL TSLRIYWQKDSKMVLAILPGKVQVWPEYKNRTITDMNDNPRIVILALRLSDSGTYTCVIQK PVLKGAYKLEHLASVRLMIRADFPVPTINDLGNPSPNIRRLICSTSGGFPRPHLYWLENGE ELNATNTTLSQDPETKLYNISSELDFNVTNNHSIVCLIKYGELSVSQIFPWSKPKQEPPID QLPFWVIIPVSGALVLTAVVLYCLACRHX7ARWKRTRRNEETVGTERLSPIYLGSAQSSG |
| SEQ ID NO:200 | Round 2 CD28F10-2 | MGNTMKWGSLPPKRPCLWLSQLLVLTGLFYFCSGITPKSVTKRVKETVNLSCDYNTSTEEL TSLRIYWQKDSKNVLAILPGKVQVWPEYKNRTITDMNDNPRIVILALRLSDSGTYTCVIQK PDLKGAYKLEHLTSVRLMIRADFPVPSTTDIGHPAPNVKRIRCSASGDFPEPRLAWMEDGE ELNAVNTTVDQDLDTELYSVSSELDFNVTNNHSIVCLIKYGELSVSQIFPWSKPKQEPPID QLPFWVIIPVSGALVLTAWLYCLACRHVARWKRTRRNEETVGTERLSPIYLGSAQSSG |

-continued

SEQUENCES

| SEQ ID | Clone ID Name | Sequence |
|---|---|---|
| SEQ ID NO:201 | Round 2 CD28F12-5* | MGHTMKWGSLPPKRPCLWLSQLLVLTGLBYFCSGITPKSVTKRVKETVNLSCDYNTSTEEL TSLRIYWQKDSKMVLAILPGKVQVWPEYKNRTITDMNDNPRIVILALRLSDSGTYTCVIQK PDLKGAYKLEHLASVRLNIRADFPVPSITDIGHPAPNVKRIRCSASGDFPEPRLAWMEDGE ELNAVNTTVDQDLDTELYSVSSELDFNVTNNHSIVCLIKYGELSVSQIFPWSKPKQEPPID QLPFWVIIPVSGALVLTAVVLYCLACRHVARWKRTRRNEETVGTERLSPIYLGSAQSSG |
| SEQ ID NO:202 | Round 2 CD28G2-8 | MGHTNKWGSLPPKRPCLWLSQLLVLTGLFYFCSGITPKSVTKRVKETVNLSCDYNTSTEEL TSLRIYWQKDSKMVLAILPGKVQVWPEYKNRTITDMNDNPRIVILALRLSDSGTYTCVIQK PVLKGAYKLEHLASVRLMIRADEPVPSINDLGNPSPNIRRLICSTSGGFPRPHLYWLENGE ELNATNTTVSQDPGTELYMISSELDFNVTNNHSIVCLIKYGELSVSQIFPWSKPKQEPPID QLPFWVIIPVSGALVLTAVVLYCLACRHVARWKRTRRNEETVGTERLSPIYLGSAQSSG |
| SEQ ID NO:203 | Round 2 CD28O1-5 | MGHTMKWGSLPPKRPCLWLSQLLVLTGLFYFCSGETPKSVTKRVKETVMLSCDYSTSTEEL TSLRIYWQKDSKMVLATLPGKVQVWPEYKNRTFPDIINNLSLMILALRLSDKGTYTCVVQK NENGSFRREHLTSVTLSIRADFPVSSITDIGHPAPNVKRIRCSASGGFPEPRLAWNEDGEE LNAVWTTVDQDLDTELYSVSSELDFNVTNNHSIVCLIKYGELSVSQIFPWSKPKQEPPIDQ LPFWVIIPVSGALVLTAVVLYCLACRHVARWKRTRRNEETVGTERLSPIYLGSAQSSG |
| SEQ ID NO:204 | Round 2 CD28G1-9 | MGHTNKWGSLPPKRPCLWLSQLLVLTGLFYFCSGITFKSVTKRVKETVMLSCDYNTSTEEL TSLRIYWQKDSKNVLATLPGKVQVWPEYKNRTITDMNDNPRIVILALRLSDSGTYTCVIQK PVLKGAYKLERLTSVRLNIRADFPVPSITDIGNPAPNVKRIRCSASGGFPEPRLAWNEDGE ELNAVNTTVDQDLDTELYSVSSELDFNVTNNHSIVCLIKYGELSVSQIFPWSKPKQEPPID QLPFWVIIPVSGALVLTAVVLYCLACRHVARWKRTRRNEETVGTERLSPIYLGSAQSSG |
| SEQ ID NO:205 | Round 2 CD28H4-3 | MGHTMKWCSLPPKRPCLWLSQLLVLTDLFYFCSGITPKSVTKRVKETVNLSCDYNTSTEEL TSLRIYWQKDSKMVLAILPGKVQVWPEYKNRTITDMNDNPRIVILALRLSDSGTYTCVIQK PVLKGAYKLEHLASVRLMIRADFPVPTINDLGNPSPNIRRLICSTS0GFPRPHLYWLENGE ELNATNTTVSQDPGTELYNISSELDFNVTNNHSIVCLIKYGELSVSQIFPWSKPKQEPPID QLPFWVIIPVSGALVLTAVVLYCLACRHVARWKRTRRNEETVGTERLSPIYLGSAQSSG |
| SEQ ID NO:206 | Round 2 CD28H11-3 | MGHTMKWGSLPPKRPCLWLSQLLVLTGLFYFCSGITPKSVTKRVKETVNLSCDYNTSTEEL TSLRIYWQKDSKMVLAILPGKVQVWPEYKNRTITDMNDNPRIVILALRLSDSGTYTCVIQK PVLKCAYKLEHLASVRLMIRADFPVPTINDLGNPSPNIRRLICSTSGGFPRPHLYWLENGE ELNATNTTLSQDPETKLYMISSELDFNVTNNHSIVCLIKYGELSVSQIFPWSKPKQEPPID QLPFWVIIPVSGALVLTAAVLYCLACRHVARWKRTRRNEETVGTERLSPIYLGSAQSSG |
| SEQ ID NO:207 | Round 2 CD28H6-6 | MGHTNKWGSLPPKRPCLWLSQLLVLTGLFYFCSGITPKSVTKRVKETVMLSCDYSTSTEEL TSLRIYWQKDSKNVLAILPGKVQVWPEYKNRTITDMNDNPRIVILALRLSDSGTYTCVIQK PVLKGAYKLEHLASVRLMIRADFPVPTINDLGNPSPNIRRLICSGFPRPHLYWLENGEELN ATNTTVSQDPGTELYNISSELDFNVTNNHSIVCLIKYGELSVSQIFPWSKPKQEPPIDQLP FWVIIPVSGALVLTAVVLYCLACRHVARWKRTRRNEETVGTERLSPIYLGSAQSSG |
| SEQ ID NO:208 | Round 2 CD28E2-4 | MGHTMKWGSLPPKRPCLWLSQLLVLTGLFYFCSGITPKSVTKRVKETVMLSCDYSTSTEEL TSLRIYWQKDSKNVLAILPGKVQVWPEYKNRTITDMNDNPRIVILALRLSDKGTYTCVIQK |

| SEQ ID | Clone ID Name | Sequence |
|---|---|---|
| | | PVLKGAYKLEHLASVRLMIRADFPVPTINDLGNPSPNIRRLICSTSGGFPRPHLYWLENGE |
| | | ELNATNTTVSQDPGTELYMISSELDFNVTNNHSIVCLIKYGELSVSQIFPWSKPKQEPPID |
| | | QLPFWVIIPVSGALVLTAVVLYCLACRHVARWKRTRRNEETVGTERLSPIYLGSAQSSG |
| SEQ ID NO:209 | Round 2 CD28B4-5a | MGHTMKWGSLPPKRPCLWLSQLLVLTGLFYFCSGITPKSVTKRVKETVMLSCDYSTSTEEL TSLRIYWQKDSKNVLAILPGKVQVWPEYKNRTITDMNDNPRIVILALRLSDSGTYTCVIQK PVLKGAYKLEHLASVRLMIRADFPVPTINDLGNPSPNIRRLICSTSGGFPRPHLYWLENGE ELNATNTTVSQDPGTELYMISSELDFNVTNNHSIVCLIKYGELSVSQIFPWSKPKQEPPID QLPFWVIIPVSGALVLTAVVLYCLACRHVARWKRTRRNEETVGTERLSPILYLGSAQSSG |
| SEQ ID NO:210 | Round 2 CD28A2-5 | MCHTMKWCSLPPKRPCLWLSQLLVLTGLFYPCSGITPKSVTKRVKETVMLSCDYNTSTEEL TSLRIYWQKDSKNVLAILPGKVQVWPEYKNRTITDMNDNPRIVILALRLSDSGTYTCVIQK PDLKGAYKLEHLASVRLMIRADFPVPSITDIGHPAPNVKRTRCSASGGFPEPRLAWMEDGE ELNAVNTTVDQDLDTELYSVSSELDFNNTSNHSFLCLVKYGDLTVSQTFYWQESKPTPSAN QHLTWTTIIPVSAPGISVIIAVILTCLTCRNAAIRRQRRENEGKCKVLSVSIGTKLKFNR |
| SEQ ID NO:211 | Round 2 CD28B4-5* | MGHTMKWGSLPPKRPCLWLSQLLVLTGLFYFCSGITPKSVTKRVKETVMLSCDYNTSTEEL TSLRIYWQKDSKNVLAILPGKVQVWPEYKNRTITDMNDNPRIVILALRLSDKGTYTCVVQK PDLKGAYKLEHLASVRLMIRADFPVPSITDIGHPAPNVKRIRCSASGGFPEPRLAWMEDGE ELNAVNTTVDQDLDTELYSVSSELDFNVTNNHSIVCLIKYGELSVSQIFPWSKPKQEPPID QLPFWVIIPVSGALVLTAVVLYCLACRHVARWKRTRRNEETVGTERLSPIYLGSAQSSG |
| SEQ ID NO:212 | Round 2 CD28D5-6 | MGHTNKWGSLPPKRPCLWLSQLLVLTGLFYFCSGTTPKSVTKRVKETVMLSCDYSTSTEEL TSLRIYWQKDSKMVLAILPGKVQVWPEYKNRTITDMNDNPRIVILALRLSDSGTYTCVIQK PVLKGAYKLEHLTSVRLMIPADFPVPTINDLGNPSPNIRRLICSTSGGFPRPHLYWLENGE ELNATNTTLSQDPETKLYMISSELDFNMTSNHSFLCLVKYGDLTVSQSFYWQESKPTPSAN QHLTWTIIIPVSAFGISVIIAVILTCLTCRNAAIRRQRRENEVENQSCSQSP |
| SEQ ID NO:213 | Round 2 CD28D10-4 | MGHTMKWGSLPPKRPCLWLSQLLVLTGLFYFCSGITPKSVTKRVKETVMLSCDYNTSTEEL TSLRIYWQKDSKNVLAILPGKVQVWPEYKNRTITDMNDNPRIVILALRLSDKGTYTCVVQK NENGSFRREHLTSVTLSIRADFPVPSITDTGHPAPIWKRIRCSASGGFPEPRLAWNEDGEE LNAVNTTVDQDLDTELYSVSSELDFNVTNNHSIVCLIKYGELSVSQIFPWSKPKQEPPIDQ LPFWVIIPVSGALVLTAVVLYCLACRHVARWKRTRRNEETVCTERLSPIYLGSAQSSG |
| SEQ ID NO:214 | Round 2 CD28E2-5* | MGHTMKWGSLPPKRPCLWLSQLLVLTGLFYFCSGTTPKSVTKRVKETVMLSCDYNTSTEEL TSLRIYWQKDSKMVLAILPGKVQVWPEYKNRTITDMNDNPRIVILALRPSDSGTYTCVIQK PVLKGAYKLEHLASVRLMIRADFPVPTINDLGNPSPNIRRLICSTSGGFPRPHLYWLENGE ELNATNTTLSQDPETKLYNISSELDFNNTSNHSFLCLVKYGDLTVSQTFYWQESKPTPSAN QHLTWTIIIPVSAFGISVIIAVILTCLTCRNAAIRRQRRENEVENQSCSQSP |
| SEQ ID NO:215 | Round 2 CD28E5-2 | MGHTNKWGSLPPKRFCLWLSQLLVLTGLFYFCSGITPKSVTKRVKETVMLSCDYNTSTEEL TSLRIYWQKDSKNVLAILPGKVQVWPEYKNRTITDMNDNPRIVILALRLSDSGTYTCVIQK PDLKGAYKLEHLASVRLMIRADFPVPTINDLGNPSPNIRRLICSTSGGFPRPHLYWLENGE |

-continued

SEQUENCES

| SEQ ID | Clone ID Name | Sequence |
|---|---|---|
| | | ELNATNTTLSQDPETKLYNISSELDFNVTNNRSIVCLIKYGELSVSQIFPWSKPKQEPPID |
| | | QLPFWVIIPVSGALLTAVVLYCLACRHVARWKRTRRNEETVGTERLSPIYLGSAQSSG |
| SEQ ID NO:216 | Round 2 CD28E8-6 | MGHTMKWGSLPPKRPCLWLSQLLVLTGLFYFCSGITPKSVTKRVKETVMLSCDYNTSTEEL TSLRIYWQKDSKMVLAILPCKVQVWPEYKNRTITDMNDNPRIVILALRLSDSGTYTCVIQK PVLKGAYKIEHLTSVRLNIRADFPVPTINDLGNPSPNIRRLICSTSGGFPRPHLYWLENGE ELNATNTTVSQDPETKLYNISSELDPNTTSNHSPLCLVKYGDLTVSQTFYWQESKPTPSAN QHLTWTIIIPVSAFGISVIIAVILTCLTCRNAAIRRQRRENEVEMQSCSQSP |
| SEQ ID NO:217 | Round 2 CD28E9-6 | MGHTMKWGSLPPKRPCLWLSQLLVLTGLFYFGSGITPKSVTKRVKETVMLSCDYNTSTEEL TSLRIYWQKDSKMVLAILPGKVQVWPEYKNRTITDNNDNPRIVILALRLSDKGTYTCVIQK PDLKGAYKLEHLASVRLMIPADFPVPTINDLGNPSPNIRRLICSTSGGFPRPHLYWLENGE ELNATNTTVSQDPGTELYMISSELDFNVTNNHSIVCLIKYGELSVSQIFPWSKPKQEPPID QLPFWVIIPVSGALVLTAWLYCLACRHVARWKRTRRNEETVGTERLSPIYLGSAQSSG |
| SEQ ID NO:218 | Round 2 CD28F3-1 | MGHTMKWGSLPPKRPCLWLSQLLVLTGLFYFCSGITPKSVTKRVKETVMLSCDYNTSTEEL TSLRIYWQKDSKNVLAILPGKVQVWPEYKNRTITDMNDNPRIVILALRLSDSGTYTCVIQK PDLKGAYKLEHLTSVRLMIRADFPVPTINDLGNPSPNIRRLICSTSGGFPRPHLYWLENGK ELNATNTTLSQDPETKLYMISSELDFNNTSNHSFLCLVKYGDLTVSQTFYWQESKPTPSAN QHLTWTIIIPVSAFGISVIIAVILTCLTCRNAAIRRQRRENEVEMQSCSQSP |
| SEQ ID NO:219 | Round 2 CD28F3-5 | MGHTNKWGSLPPKRPCLWLSQLLVLTGLFYFCSGITPKSVTKRVKETVMLSCDYNTSTEEL TSLRIYWQKDSKMVLAILPGKVQVWPEYKNRTITDMNDNPRIVILALRLSDSGTYTCVVQK NENGSFRREHLTSVTLSIRADFPVPSITDIGHPAPNVKRIRCSASGGFPEPRLAWNEDGEE LNAVNTTVDQDLDTELYSVSSELDFNVTNNHSIVCLIKYGELSVSQIFPWSKPKQEPPIDQ LPFWVIIPVSGALVLTAWLYCLACRHVARWKRTRRNEETVGTERLSPIYLGSAQSSG |
| SEQ ID NO:220 | Round 2 CD28F3-6 | MGHTNKWGSLPPKRPCLRLSQLLVLTGLFYFCSGITPKSVTKRVKETVMLSCDYSTSTEEL TSLRIYWQKDSKNVLAILPGKVQVWPEYKNRTITDNNDNPRIVILALRLSDSGTYTCVIQK PDLKGAYKLEHLTSVRLMIRADFPVPTINDLGNPSPNIRRLICSTSGGFPRPHLYWLENGE ELNATNTTLSQDPETKLYMISSELDFNVTNNHSIVCLIKYGELSVSQIFPWSKPKQEPPID QLPFWVIIPVSGALVLTAVVLYCLACRHVARWKRTRRNEETVGTERLSPIYLGSAQSSG |
| SEQ ID NO:221 | Round 2 CD2SF11-8 | MGHTMKWGSLPFKRPCLWLSQLLVLTGLFYFCSGITPKSVTKRVKETVMLSCDYNTSTEEL TSLRIYWQKDSKMVLAILFGKVQVWPEYKNRTITDMNDNPRIVILALRLSDSGTYTCVIQK PVLKGAYKLEHLTSVRLNTRADFPVPTTNDLGNPSPNTRRLICSTSGGFPEFELYWLENGE ELNATNTTLSQDPETKLYNISSELDFNNTSNLCLVKYCDLTVSQTFYWQESKPTPSANQHL TWTIIIPVSAPGISVIIAVILTCLTCENAAIRRQRRENEVENQSCSQSP |
| SEQ ID NO:222 | Round 2 CTLA4 5x9-d10 | MSHTRRQGTSPSKCPYLKFFQFLVLASLSHFCSGVIHVTKEvKEVATLSCGLNVSVEELAQ TRIYWQKGKKMVLTNNSGDMNTWPEYKNRTIPDITNNLSIVILALRPSDEGTYECVVLEYE KDAFKREHLAEVMLSVKADFPTPSISDFEIPPSNTRRIICSTSGGFPEPHLSWLENGEELN AINTTASQDPGTELYTVSSKLDFNMTTNHSPNCLIKYGHLRVNQTPNWNTPKQEHFPDNLL PSWAITLISVNGIFVICCLTNCFAPRCRERRRNERLRRESARPV |

-continued

SEQUENCES

| SEQ ID | Clone ID Name | Sequence |
|---|---|---|
| SEQ ID NO:223 | Round 2 CTLA4 5x6-f6 | MGYTRRQGTSPSKCPYLKFFQLLVLASLSHFCSGVIHVTKEVKEVATLSCGHNVSVEELAQ TPIYWQKEKKNVLTMMSGDMNIWPEYKNRTIFDITNNLSIVILALRPSDEGTYECVVLKYE KDAFKREHLAEVMLSVKADFPTPSTTDPEIPPSNIRRTICSTSGGFPEPHLPWLENGEELN AINTTVSQDPETELYTVSSKLDFNNTTNRSFVCLIKYGHLRVNQTFNNNTPKQEHFPDNLL PEWAITLISANGIFVICCLTYRPAPRCRERRRNERLRRESVCPV |
| SEQ ID NO:224 | Round 2 CTLA4 5x5-h12 | MGYTRRQGISPSKCPYLKFFQLLVLASLSNPCSGVINVTKKVKEVATLSCGHNVSVEELAQ TRIHWQKEKKMVLTMMSGDNNIWPEYKNRTIFDITNNLSIVILALRPSDEGTYECVVLKYE KDAFKREHLAEVNLSVKADFPTPSISDPEIPPSNIRRTICSTSGGPPEPELSWLENGEELN AINTTVSQDPGTELYTVSSKLDFNMTTDRSFVCLIKYGHLRVNQTFNWNTPKQEHFPDNLL PSWAITLISVNGIFVICCLTYCFAPRCRERRRNGRLRRESVRPV |
| SEQ ID NO:225 | Round 2 CTLA4 5x5-c10 | MSHTQRQGISPSKCPYLNFFQLLVLASLSHFCSGVIHVTKEVKEVATLSCGNNVSVEELAQ TRIYWQKEKKMVLTNNSGDNNIWPEYKNRTIFDITNNLSIVILALRPSDEGTYECVVLEYE KDAFKRENLAEVTLSVKADFPTPSITDFEIPP5NIRRIIC5T5QGFPEPFHLFWLENQEELN AISTTVSQDPETELYAVSSKLDFNMTTNNSFMCLIKYGNLRVNQTFNWNTTKQEHFPDNLL PSWAITLISVNGIFVICCLTYCFAPRCRERRRNERLRRESVHPV |
| SEQ ID NO:226 | Round 2 CTLA4 5x3-e8 | MGHTRRQGTSPSKCPYLKFPQLLVLAGLSHLCSGVIHVTKEVKEVATLSCGHNVSVEELAQ TRIYWQKEKKMVLTNNSGDNNIWPEYKNRTIFDITNNLSIVILALRPSDEGTYECVVLEYE KDAFKREHLAEVTLSVKADFPTPSISDFEIPTSNIRRIICSTSGGFPEPHLFWLENGEELN AINTTVSQDPETELYTVSSKLDFNNTANHSEVCLIKYGNLRvNQTFNNNTPKQENFPDNLL PSWAITLISVNGIFVICCLTYCFAPGCRERRENERLRRESVCPV |
| SEQ ID NO:227 | Round 2 CTLA4 5x3-c4 | MSHIRRQGISPSKCPYLNFFQLLVLACLSHFCSGVIEVTKEVKEVATLSCGHNVSVEELAQ TRIYWQKEKKNVLTNMSGDMNIWPEYKNRTIFDITNNLSIVILALRPSDEGTYECVVLKYE KDAFKRENLAEVTLSVKADFPTPSISDFEIPPSNIRRIICSTSGGFPEPRLAWNEDGEELN AINTTASQDPETELYTVSSKLDFNNTTNRSFVCLIKYGNLRVNQTFNWNTPKQEHFPDNLF PSWAITLISVNGIFVICCLTYCFAPRCRERRRNERLRRESVRPV |
| SEQ ID NO:228 | Round 2 CTLA4 5c3-c3 | MSHTRRQGTSPSKCPYLKFFQLLVLASLSHFCSGVIHMTKEVKEVATLSCGPNVSVEELAQ TRIYWQKEKK4VLTNNSGDNNIWPEYKNRTIFDITNNLSIVILALRPSDEGTYECVVLEYE KDAFKREHLAEVTLSVKADFPTPSISDFEIPTSNIRRIICSTSGGFPEPHLSWLENGEELN AINTTVSQDPGTELYTVSSKLDFNMTTNHSFNCLIKYGHLRVNQTFNWNTPKQENFPDNLL PEWAITLISVNGIFVICCLTHCFAPRCRERRRNERLRRESVCPV |
| SEQ ID NO:229 | Round 2 CTLA4 5x2-h11 | MSHTRRQGISSSKCPYLKFFQLLVLACLSHFCSGVIHVTKKVKEVATLSCGHNVSVEELAQ TRIYWQKGKKNVLTNNSGDNNIWPECKNRTIFDITNNLSIVILALRPSDEGTYECAVLKYE KDAFKREHLAEVTLSVKADFPTPSISDFEIPTSNIRRIICSTSGGFPEPHLEWLENGEELN AINTTASQDPETELYAVSSKLDFNMTTNHSFMCLIKYGELRVNQTFNWNTPKQENFPDNLL PSWAITLISVNGIEVICCLTYCFAPRCRERKSNERLRRESVRPV |

-continued

SEQUENCES

| SEQ ID | Clone ID Name | Sequence |
|---|---|---|
| SEQ ID NO:230 | Round 2 CTLA4 5x2-d7 | MGYTRRQGTSPSECPYLKFEQLLVLAGLSHFCSGVINNTKEVKEVATLSCGLNVSVEELAQ TRIHWQKEKKNVLTNNSGDNNIWPEYKNRTIFDITNNLSIVILALRPSDEGTYECVVLKYE KDAFKREHLAEVMLSVKADFPTPSISDFEIPPSNIRRIICSTSGGFPEFHLSWLENGEELN AINTTVSQDPETGLYTVSSKLDENNTTNHSEMCLIKYGHLRVNQTFNWNTPKQENFPDNLL PSWAITLISVNGIFVICCLTYCFAPRCRERRENERLRRESVRPV |
| SEQ ID NO:231 | Round 2 CTLA4 5x2-b7 | MENTREQGISPSKCPYLNFFRLLVLASLSHFCSGVIHVTKEVKEVATLSCGNNVSVEELAQ TRIHWQKEKKMVLTMMSGDMNIWPEYKNRTIFDITNNLSIVILAWRPSDEGTYECVVLKYE KDAFKREHLAEVTLSVKADFPTPSITDFEIPPSNIRRIICSTSGGFPEPHLSWLENGEELN AINTTVSQDPGTELYTVSSKLDFNMTTNHSFVCLIKYGNLRVNQTFNWNTPKQEHFPDNLL PSWAITLISANGIPVICCLTYCFAPRCRERRRNERLRRESVRPV |
| SEQ ID NO:232 | Round 2 CTLA4 5x2 -b1 | MSHTRRQGISPSKCPYLKFFQLLVLASLSNECSGVIHVTKEvKEVATLSCGHNVSVEELAQ TRTYWQKEKKMVLTMMSGDMNIWPEHKNRTIFDITNNLSIVILALRPSDEGTYECVVLKYE KDAFKREHLAEVMLSVKADFPTPSISDFEIPPSNIRRIICSTSGGFPEPNLSWLENGEELN ATNTTVSQDPETELYTGSSKLDFNMTTNHSFMCLIKYGHLRVNQTFSWNTPKQEHFPDNLL PSWAITLISANGIFVICCLTYCFAPRCRERRNETLRRESVRPVWGTKLKFKPXIS |
| SEQ ID NO:233 | Round 2 CTLA4 5x1-f1 | MGHTRRQGISPSKCPYLKFEQLLVLASLSHFCSGVIHVTKEVKEVATLSCGLNVSVEELAQ TRIYWQKEKKMVLTMMSGDMNIWPEHKNRTIFDITNNLSIVILALRPSDEGTYECVVLKYE KDAFKREHLAEVTLSVKADEPTPSITDFEIPPSNIRRIICSTSGGFPEPHLFWLENGEELN AINTTASQDPETELYTVSSKLDFNNTANHSFVCLIEYGHLRVNQTENWNTPKQEHFPDNLL PSWAITLTSVNGIFVTCCLTYCFAPRCRERRRNETLRRESVRPV |
| SEQ ID NO:234 | Round 2 CTLA4 5x1-d7 | MGYTRRQGTSPSKCPYLNFFQLLVLASLSHFCSGVIHVTKEVKEVATLSCGHNVPVEELAQ TRIYWQKEKKNVLTMMSGDDMNIWPEYKNRTIFDITNNLSIVILALRPSDEGTYGCWLEYE KDAFKREHLAEVMLSVKADFPTPSITDLETPPSNIRRITCSTSGGFPEPHLFWLENGEELN AINTTASQDPETELYAVSSKLDFNMTTNHSFMCLIKYGHLRVNQTENWNTPKQEHFPDNLL PSWAITLISANGILFVICCLTYCFAPRCRERRNERLRRESVHPV |
| SEQ ID NO:235 | Round 2 CTLA4 2x4-g9 | MGHTRRQGISPSKCPYLKFFQLLVLACLSHFCSGVIHVTKEVKEVATLSCGHNVSVEELAQ TRIYWQKDKKMVLTMMSGDMNIWPEYKNQTIFDITNNLSIVILALRPSDEGTYECVVLKYE KDAFKQEHLAEVMWSVKADFPTPSTSDFEIPPSNIRRIICSTSGGFPEPRLAWMEDGEELN AISTTVSQDPGTELCTVSSKLDFNNTTNHSFMCLIRYGHLRVNQTFNWNTPKQEHFPDNLL PSWAITLISVKGIFVICCLTYCEAPRGRERKSNGRLRRESVHPV |
| SEQ ID NO:236 | Round 2 CTLA4 2x4-aG | MGHTRRQGTSPSKCPYLKFFQLLVLAGLSHFCSGVIHVTKEVKEVATLSCGHNVSVEELAQ TRIHWQKEKKNVLTMMSGDMNIWPEYKNRTIFDITNNLSTVILALRFSDEGTYECVVLKYE KDAFKREHLAEVMLSVKADFPTPSISDFEIPPSNIRRIICSTSGGFFEPHLFWLENGEELN AISTTVSQDPETELYAXSSKLDFNNTTNHSFMCLIKYGHLRVNQTFNWNTPKQEHFPDNLL PSWAITLISVNGIFVICCPTYCFAPRCRERRRNERLRRESVCPV |

| SEQ ID | Clone ID Name | Sequence |
|---|---|---|
| SEQ ID NO:237 | Round 2 CTLA4 2x2-f3 | MGHTRRQGISPSKCPYLKFEQLLVLACLSHFCSGVIYVTKEVKEVATLSCGHNVSVEELAQ TRIWQKEKKMVLIW4SGDN1JIWPEYKNRTIFDITNNLSTVILALRPSDEGTECVVLKYEK DAFKREHLAEVTLSVKADFPTPSISDFEIPPSNIRRIICSTSGGEPEPHLSWLENGEELNA INTTVSQDPGTELYTVSSKLDFNMTTNHSFMCLIKYGHLRVNQTFNWNTPKQEHFPDNLLP SWAITLISVNGIFVICCLTYCFAPRCRERRRNERLRRESVCEXT |
| SEQ ID NO:238 | Round 2 CTLA4 2x2-f12 | MGHTRRQGTSPSKCPYLKFFQLLVLAGLSHFCSGVIHVTKEVKEVATLSCGHNVSVEELAQ TRIHWQKEKKMVLTMMSGDMNIWPEYKNRTIFDITNNLSIVILALRPSDEGTYGCVVLEYE KDAFKREHLAEVNLSVKADFPTPSISDFEIPPSNIRRIICSTSGGFPEPHLSWLENGEELN AINTTVSQDPETELYAVSSKLDFNNTTNHSFNCLIKYGHLRANQTFNWNTPKQENFPDNLL PSWAITLISVNGIFVICCLTYCFAPRCRERRRNERLRRESVREV |
| SEQ ID NO:239 | Round 2 CTLA4 2x1-gS | MGYTRRQGTSPSKCPYLNFFQLLVLASLSHFCSGVIHVTKEVKEVATLSCGHNVSVEELAQ TRIHWQKEKKMVLTMMSGDMNIWPEYKNRTIFDITNNLSVVILLALRPSDEGTYECWLKYE KDAFKREHLAEVTLSVKADFPTPSITDFEIPPSNIRRIICSTSGGFPEPHLSWLENGEELN AINTTVSQDPGTELYTVSSKLDFNMTTNRSFVCLIKYGHLRVNQTFNWNTPKQEHFPDNLL PSWAITLISVNGIFVICCLTYCFAPRCRERKSNERLRRESVRFV |
| SEQ ID NO:240 | Round 2 CTLA4 2x1-f10 | MGYTRRQGISPSKCPYLKFFQLLVLAGLSNECSGVIWJTKEVKEVATLSCGHNVSVEELAQ TRIHWQKEKKMVLTMMSGDMNIWPEYKNRTIFDITNNLSIVILALRPSDEGTYECVVLKYE KDAFKREHLAEVMLSVKADFPTPSITDFEIPPSNIRRIICSTSGGEPEPRLAWMEDGEELN AINTTVSQDPGTELYAVSSKLDFNNTTNHSEMCLIKYGHLRVNQTFNWNTFKQEHFPDNLL PSWAITLISVNGISVICCLTYCFAPRCRERRRNERLRRESVCPV |
| SEQ ID NO:241 | Round 2 CTLA4 2x1-c9 | MSHTRRQGISPSKCPYLKEFQLLVLAGLSHFCSGVIHVTKEVKEVATLSCGHNVSAEELAQ TRIYWQKEKKMVLTMMSGDMNIWPEYKITRTIFDITNNLSIVILALRPSDEGTYECWLEYE KDAFKREHLAEVNLSVKADFPTPSITDFEIPTSNIRRIICSTSGGFPEPRLAWMEDGEELN AISTTASQDPETELYTVSSKLDFNMTTNHSFMCLIKYGHLRVNQTFNWNTPKQEEFPDNLL PSWAITLISVNCIEVICCLTHCFAFRCRERRPYERLRRESVCPV |
| SEQ ID NO:242 | Round 2 CTLA4 2x1-h12 | MGHTRRQGISPSKCPYLKFFQLLVLAGLSHFCSGVIHVTKEVKEVATLSCGLNVSVEELAQ TRIHWQKEKKNVLTW4SGDNNIWPEYKNRTIFDITNNLSIVILALRPSDEGTYECVVLKYE KDAFKREHLAEVMLSVKADFPTPSITDFEIPFSNIRRIICSTSCGFPEPHLSWLENCEELN AINTTVSQDPGTELYTVSSKLDFNMTTNHSFMCLIKYGHLRVNQTFNWNTPKQEHFPDNLL PSWAITLISANGIFVICCLTYCFAPRCRERKSNERLRRESVCEXT |
| SEQ ID NO:243 | Round 2 CTLA4 2x1-e2 | MGYTRRQGISPSKCPYLKFFQLLVLACLSHFCSGVIHVTKEVKEVATLSCGHNVSDEELAQ TRIHWQKEKKMVLTMMSGDMNIWPEYKNRTIFDITNNLSIVILALRPSDEGTYECVVLKYE KDAFKREHLAEVTLSVKADFPTPSISDFEIPPSNIRRIICSTSGGFPEPHLSWLENGEELN ATNTTVSQDPGTELYTVSSKLDFNMTTNHSFMCLIKYGHLRVNQTFNWNTFKQEHFPDNLL PSAITLISANGIFVICCLTYCFAPRCRERRPNERLRRESIHPV |

-continued

SEQUENCES

| SEQ ID | Clone ID Name | Sequence |
|---|---|---|
| SEQ ID NO:244 | Round 2 CTLA4 2x1-c4 | MGYTRRQGISPSKCPYLKFFQLLVLAGLSHLCSGVIHVTKEVKEVATLPCGHNVSVEELAQ TRIHWQKEKKMVLTMMSGDMNIWPEYKNRTIFDITNNLSIVILALRPSDEGTYECVVLKYE KDAFKREHLAEVMLSVKADFPTPSTTDFETPPSNIRRTICSTSGGFPEPHLFWLENGEELN AINTTVSQDFGTELYAVSSKLDFNMTTNHNFMCLIKYGHLRVNQTFNWNTPKQEHFPDNLL PSWAITLISVNGIFVICCLTYCFAPRCRERRRNERLRRESVRPV |
| SEQ ID NO:245 | Round 2 CTLA4 2x1-b12 | MGHTRRQGISPSKCFYLKFFQLLVLAGLSHLCSGVIHMTKEVKEVATLSCGHNVSVEELAQ TRIYWQKEKKMVLTMMSGDMNTWPEYKNRTTFDITNNLSIVILALRPSDEGTYECVALKYE KDAFKQEHLAEVTLSVKADFPTPSISDFEIPFSNTRRIICSTSGGFPEFRLAWMEDGEELN AINTTVSQDPETELYTVSSKLDFNNTANHSFMCLIKYGHLRVNQTFNWNTPKQEHFPDNLL PSWAITLISVNGIFVICCLTYCFAPRCRERRRNERLRRESVCPV |
| SEQ ID NO:246 | Round 2 CTLA4 2x2-f1 | MGHTRRQGISPSKCPYLKFFQLLGLACLSHFCSGVIHVTKEVKEVATLSCGHNVSVEELAQ TRIHWQKEKKMVLTMMSGDMNIWPEYKNRTIPDITNNLSIVILALRLSDEGTYECVVLKYE KDAFKREHLAEVTLSVKADFPTPSISDFEIPTSNTRRIICSTSGGFPEPHLFWLENGEELN AINTTASQDPETELYTVSSKLDFNMTTNRSFVCLIKYGHLRVNQTFNWNTPKQEHFPDNLL PSWAITILISVNGIFVICCLTYCFAPRCRERRRNERLRRESVRPV |
| SEQ ID NO:247 | Round 2 CTLA4 5x4-h1 | MSHTRRQGISPSKCPYLKFFQLLVLACLSHFCSGVIHVTKEVKEVATLSCGHNVSVEELAQ TRIHWQKEKKNVLTNMSGDMNIWPEYKNRTIPDITNNLSIVILALRPSDEGTYEGVVLKYE KDAFKRKHLAEVMLSVKADFPTPSISDFEIPTSNIRRIICSTSGGFPEFHLFWLENGEELN AINTTASQDPETELYTVSSKLDFNMTTNRSFVCLIKYGHLRVNQTFNWNTPKQEHFPNNLL PSWAITLISVNGIFVICCLTYCFAPRCRERRRNETLRRESVHPV |
| SEQ ID NO:248 | Round 2 CTLA4 5x4-a1 | MGHTRRQGTSPSKCPYLKFFQLLVLAGLSHFCSGVIHVTKEVKEVATLSCGHNVSVEELAQ TRIYWQKEKKMVLTMMSGDMNIWPEHKNRTIFDITNNLSIVILALRPSDEGTYECVVLKYE KDAFKREHLAEVTLSVKADFPTFSITDFEIPTSNIRRIICSTSGGFPEPNLSWLENGEELN AINTTVSQDPGTELYTVSSKLDFNMTTNRSFVCLIKYGHLRVNQTFNWNTPKQEHFPDNLL PSWAITLISVNGIFVICCLTYCFAPRCRERRRNERLRRESVRPV |
| SEQ ID NO:249 | Round 2 CTLA4 5x2-f3 | MSHTRRQGISPSKCPYLKFFQLLVLASLSHFCSGVIHVTKEVKEVATLSCGHNVSVEELAQ TRIYWQKEKKMVLTMJAPGDMNIWPEYKNRTIFDITNNLSIVILALRPSDEGTYECWLRYE KDAFKREHLAEVTLSVKADFPTPSISDFEIPTSNIRRIICSTSGGFPEPHLSWLENGEELN AINTTASQDPETELYTVSSKLDFNMTTNRSFVCLIKYGHLRVNQTFNWNTPKQEHFPDNLL PSWAITLISANGIFVICCLTHCFAPRCRERKSNERLRRESVRPV |
| SEQ ID NO:250 | Round 2 CTLA4 5x2-e12 | MSHTRRQGISPSKCPYLKFFQLLVLAGLSHFCSGVIHVTKEVKEVATLSCGHNVSVEELAQ TRIHWQKEKKMVLTMNSGGMNIWPEYKNRTIFDITNNLSIVILALRPSDEGTYECVVLKYE KDAFKREHLAEVTLSVKADFPTPSISDFEIPTSNIRRIICSTSGGFPEPHLSWLENGEELN AISTTVSQDPGTELYAVSSKLDFNMTTNRSFVCLIKYGHLRVNQTFNWNTTKQEHFPDNLL PSWAITLISVNGIFVICCLTYCFAFRCRERRRNERLRRESVRPV |

-continued

SEQUENCES

| SEQ ID | Clone ID Name | Sequence |
|---|---|---|
| SEQ ID NO:251 | Round 2 CTLA4 2x4-h11 | MGYTRRQGTSPSKCPYLKFFQLLVLACLSHFCSGVIHVTKEVKEVATLSCGHNVSVEELAQ TRIYWQKEKKNVLTNNSGDBMNIWPEYKNRTIFDITNNLSIVILALRPSDEGTYECWLEYE KDAFKREHLAEVMLSVKADFPTPSISDFEIPPSNIRRIICSTSGGFPEPHLSWLENGEELN AINTTVSQDPGTELYAVSSKLDFNMTTNHSFMCLIKYGHLRVNQTFNWNTPKQEHFPDNLL PSWAITLISVNGTFVICCLAYCFAPRCRGRRRNERLRRESVRPV |
| SEQ ID NO:252 | Round 2 CTLA4 2x3-h2 | MGHTRRQGTSPSKCPYLNFFQLLVLACLSHFCSGVIHVTKEVKEVATLSCGHNVSVEELAQ TRIYWQKEKKNVLTMMSGDNNIWPEYKNRTIFDITNNLSIVILALRP5DEGTYECVVLKYE KDAFKREHLAEVMLSVKADFPTPSISDFEIPPSNIRRIICSTPGGFPEPRLAWMEDGEELN AISTTVSQDPGTELYAVSSKLDFNNTTNHSFMGLIKYGHLRVNQTFNWNTTKQEHFPDNLL PSWAITLISVKGIFVICCLTYCFAPRWRERKSNERLRRESVRPV |
| SEQ ID NO:253 | Round 2 CTLA4 A-H3-6 | ATGGGCCACACGCTGAGCCCGGGAACTCCACTGCCCAGGTGTCTACACCTCAAGCTCTGCC TGCTCTTGGCGCTGGCGGGTCTCCACTTCTCTTCAGGTATCAGCCAGGTCACCAAGTCGGT GAAAGAAATGGCAGCACTGTCCTGTGATTACAACATTTCTATCGATGAACTGGCGAGAATG CGCATATACTGGCAGAAGGACCAACAGATGGTGCTGAGCATCATCTCTGGGCAAGTGGAAG TGTGGCCTGAGTACAAAAACCGCACCTTCCCCGACATCATTAACAACCTCTCCCTTATGAT CCTGGCACTGCGCCTGTCGGACAAGGGCACCTACACCTGCGTGGTTCAGAAGAATGAGAAC GGGTCTTTCAGACGGGAGCACCTGACCTCCGTGACACTGTCCATCAGAGCTGACTTCCCTG TCCCTAGCATAAATGATCTTGGAAATCCATCTCCTAATATCAGAAGGCTAATTTGCTCAAC ACCAACACAACACTGTCCCAAGATCCTGAAACCAAGCTCTACATGATTAGCAGTGAACTGG ATTTCAACATGACAAGCAATCACAGCTTCTTGTGTCTTGTCAAGTATGGAGACTTAACAGT GTCACAGACCTTCTACTGGCAAGAATCCAAACCAACCCCTTCTGCTAATCAGCACCTGACC TGGACCATTATTATCCCAGTCTCAGCATTTGGGATTTCTGTGATCATTGCAGTTATACTAA CATGCCTGACCTGCAGAAATGCTGCAATACGCAGACAGAGAAGGGAGAATGAAGTGGAAAT GCAAAGTTGCTCTCAGTCTCCATGAG |
| SEQ ID NO:254 | Round 2 CTLA4 A-B11-5 | ATGGGTCACACAATGGAGTGGGGATCACTACCACCCAAGCGCCCATGCCTCTGGCTCTCTC AGCTCTTGGTGCTCACTGGTCTTTTTTACTTCTGTTCAGGCATCACCCCAAAGAGTGCGAC CAAAAGAGTGAAAGAAACAGTAATGCTATCCTGTGATTACAGCACATCCACTGAAGAACTG ACAAGCCTTCGGATCTATTGGCAAAAGGATAGTAAAATGGTGCTGGCCATCCTGCCTGGAA AAGTGCAGGTGTGGCCTGAGTACAAGAACCGCACCATCACTGACATGAACGATAACCCCCG TATTGTGATCCTGGCTCTGCGCCTGTCGGACAGTGGCACCTACACCTGTGTTATTCAGAAG CCTGATTTGAAAGGGCTTATAAACTGGAGCACCTGACTTCCGTGAGGTTAATGATCAGAG CTGACTTCCCTGTCCCTACCATAAATGATCTTGGAAATCCATCTCCTAATATCAGAAGGCT AATTTGCTCAACCTCTGGAGGTTTTCCAAGGCCCCACCTCTACTGGTTGGAAAATGGAGAA GAATTAAATGCTACCAACACAACACTGTCCCAAGATCCTGAAACCAAGCTACATGATTA GCAGTGAACTGGATTTCAACATGACAAGCAATCACAGCTTCTTGTGTCTTGTCAAGTATGG AGACTTAACAGTGTCACAGACCTTCTACTGGCAAGAATCCAAACCAACCCCTTCTGCTAAT CAGCACCTGACCTGGACCATTATTATCCCAGTCTCAGCATTTGGGATTTCTGTGATCATTG |

| SEQ ID | Clone ID Name | Sequence |
|---|---|---|
| | | CAGTTATACTAACATGCCTGACCTGCAGAAATGCTGCAATACGCAGACAGAGAAGGGAGAA |
| | | TGAAGTGGAAATGCAAAGTTGCTCTCAGTCTCCATAG |
| SEQ ID NO:255 | Round 2 CTLA4 A-E2-6 | ATGGGCCACACAATGAAGTGGGGATCACTACCACCCAAGCGCCCATGCCTCTGGCTCTCTC |
| | | AGCTCTTGGTGCTCACTGGTCTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAGTGGCACCTACACCTGCGTGGTTCAGAAG |
| | | AATGAGAACGGGTCTTTCAGACGGGAGCACCTGACCTCCGTGAGGTTAATGATCAGAGCTG |
| | | ACTTCCCTGTCCCTACCATAAATGATCTTGGAAATCCATCTCCTAATATCAGAAGGCTAAT |
| | | TTGCTCAACCTCTGGAGGTTTTCCAAGGCCCCACCTCTACTGGTTGGAAAATGGAGAAGAA |
| | | TTAAATGCTACCAACACAACACTGCCCCAAGATCCTGAAACCAAGCTCTACATGATTAGCA |
| | | GTGAACTGGATTTCAACATGACAAGCAATACACAGCTTCTTGTGTCTTGTCAAGTATGGAGA |
| | | CTTAACAGTGTCACAGACCTTCTACTGGCAAGAATCCAAACCAACCCCTTCTGCTAATCAG |
| | | CACCTGACCTGGACCATTATTATCCCAGTCTCAGCATTTGGGATTTCTGTGATCATTGCAG |
| | | TTATACTAACATGCCTGACCTGCAGAAATGCTGCAATACGCAGACAGAGAAGGGAGAATGA |
| | | AGTGGAAATGCAAAGTTGCTCTCAGTCTCCATGAG |
| SEQ ID NO:256 | Round 2 CTLA4 A-F1-6 | ATGGGTCACACAATGAAGTGGGGATCACTACCACCCAAGCGCCCATGCCTCTGGCTCTCTC |
| | | AGCTCTTGGTGCTCACTGGTCTTTTTACTTCTGTTCAGGCATCACCCCAAAGAGTGTGAC |
| | | CAAAAGAGTGAAAGAAACAGTAATGCTATCCTGTGATTACAGCACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAAGGGCACCTACACCTGCGTGGTTCAGAAG |
| | | AATGAGAACGGGTCTTTCAGACGGGAGCACCTGACTTCCGTGAGGTTAATGATCAGAGCTG |
| | | ACTTCCCTGTCCCTACCATAAATGATCTTGGAAATCCATCTCCTAATATCAGAAGCCTAAT |
| | | TTGCTCAACCTCTGGAGGTTTTCCAAGGCCCCACCTCTACTCGTTGGAAAATGGAGAAGAA |
| | | TTAAATGCTACCAACACAACACTGTCCCAAGATCCTGAAACCAAGCTCTACATGATTAGCA |
| | | GTGAACTGGATTTCAACATGACAAGCAATACACAGCTTCTTGTGTCTTGTCAAGTATGGAGA |
| | | CTTAACAGTGTCGCAGACCTTCTACTGGCAAGAATCCAAACCAACCCCTTCTGCTAATCAG |
| | | CACCTGACCTGGACCATTATTATCCCAGTCTCAGCATTTGGGATTTCTGTGATCATTGCAG |
| | | TTATACTAACATGCCTGACCTGCAGAAATGCTGCAATACGCAGACAGAGAAGGGAGAATGA |
| | | AGTGGAGATGCAAAGTTGCTCTCAGTCTCCATAG |
| SEQ ID NO:257 | Round 2 CTLA4 A-F6-9 | ATGGGTCACACAATGAAGTGGGGATCACTACCACCCAAGCGCCCATGCCTCTGGCTCTCTC |
| | | AGCTCTTGGTGCTCACTGGTCTTTTTACTTCTGTTCAGGCATCACCCCAAAGAGTGTGAC |
| | | CAAAAGAGTGAAAGAAACAGTAATGCTATCCTGTGATTACAGCACATCCACTGAAGAACTG |
| | | ACAAGCCTTCGGATCTATTGGCAAAAGGATAGTAAAATGGTGCTGGCCATCCTCCCTGGAA |
| | | AAGTGCAGGTGTGGCCTGAGTACAAGAACCGCACCATCACTGACATGAACGATAACCCCCG |

-continued

SEQUENCES

| SEQ ID | Clone ID Name | Sequence |
|---|---|---|
| | | TATTGTGATCCTGGCTCTGCGCCTGTCGCACAGTGGCACCTACACCTGTGTTATTCAGAAG |
| | | CCTGATTTGAAAGGGGCTTATAAACTGGAGCACCTGACTTCCGTGAGGTTAATGATCAGAG |
| | | CTGACTTCCCTGTCCCTACCATAAATGATCTTGGAAATCCATCTCCTAATATCAGAACGCT |
| | | AATTTGCTCAACCTCTGGAGGTTTTCCAAGGCCCCACCTCTACTGGTTGGAAAATGGAGAA |
| | | GAATTAAATGCTACCAACACAACACTGTCCCAAGATCCTGAAACCAAGCTCTACATGATTA |
| | | GCAGTGAACTGGATTTCAACATGACAAGCAATCACAGCTTCTTGTGTCTTGTCAAGTATGG |
| | | AGACTTAACAGTGTCACAGACCTTCTACTGGCAAGAATCCAAACCAACCCCTTCTGCTAAT |
| | | CAGCACCTGACCTGCACCATTATTATCCCAGTCTCAGCATTTGGGATTTCTGTGATCATTG |
| | | CAGTTATACTAACATGCCTGACCTGCAGAAATGCTGCAATACGCAGACAGAGAAGGGAGAA |
| | | TGAAGTGGAAATGCAAAGTTGCTCTCAGTCTCCATGA |
| SEQ ID NO:258 | Round 2 CTLA4 A-H4-5* | ATGGGTCACACAATGAAGTGCGGATCACTACCACCCAAGCGCCCATGCCTCTGGCTCTCTC |
| | | AGCTCTTGGTGCTCACTGGTCTTTTTACTTCTGTTCAGGCATCACCCCAAAGAGTGTGAC |
| | | CAAAAGAGTGAAAGAAACAGTAATGCTATCCTGTGATTACAGCACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTCCGCCTGTCGGACAAGGGCACCTACACCTGCGTGGTTCAGAAG |
| | | AATGAGAACGGGTCTTTCAGACGGGAGCACCTGACCTCCGTGACACTGTCCATCAGAGCTG |
| | | ACTTCCCTGTCCCTAGCATAACTGACATTGGACATCCCGCCCCTAATGTGAAAAGGATAAG |
| | | ATGCTCCGCCTCTCGAGGTTTTCCAGAGCCTCGCCTCTACTGGTTGGAAAATGGAGAAGAA |
| | | TTAAATGCTACCAACACAACAGTTTCCAAGATCCTGGAACTGAGCTCTACATGATTAGCA |
| | | GTGAACTGGATTTCAATGTGACAAATAACCACAGCATCGTGTGTCTCATCAAATACGGGGA |
| | | GCTGTCGGTGTCACAGATCTTCCCTTGGAGCAAACCCAAGCAGGAGCCTCCCATTGATCAG |
| | | CTTCCATTCTGGGTCATTATCCCAGTAAGTGGTGCTTTGGTGCTCACTGCGGTAGTTCTCT |
| | | ACTGCCTGGCCTGCAGACATGTTGCGAGGTGGAAAAGAACAAGAAGGAATGAAGAGACAGT |
| | | GGGAACTGAAAGGCTGTCCCCTATCTACTTACGCTCTGCGCAATCCTCGCGCTGAG |
| SEQ ID NO:259 | Round 2 CTLA4 A-B4-6 | ATGGATCACACAATGAAGTGGGGATCACTACCACCCAAGCGCCCATGCCTCTGGCTCTCTC |
| | | AGCTCTTGGTGCTCACTGGTCTTTTTACTTCTGTTCAGGCATCACCCCAAAGAGTGTGAC |
| | | CAAAAGAGTGAAAGAAACAGTAATGCTATCCTGTGATTACAACACATCCACTGAAGAACTG |
| | | ACAAGCCTTCGGATCTATTGGCAAAAGGATAGTAAAATGGTGCTGGCCATCCTGCCTGGAA |
| | | AAGTGCAGGTGTGGCCTGAGTACAAGAACCGCACCATCACTGACATGAACGATAACCCCCG |
| | | TATTGTGATCCTGGCTCTGCGCCTGTCGGACAAGGGCACCTACACCTGCGTGGTTCAGAAG |
| | | AATGAGAACGGGTCTTTCAGACGGGAGCACCTGACCTCCGTGACACTGTCCATCAGAGCTG |
| | | ACTTTCCTGTCCCTACCATAAATGATCTTGGAAATCCATCTCCTAATATCAGAAGGCTAAT |
| | | TTGCTCAACCTCTGGAGGTTTTCCAAGCCCCACCTCTACTGGTTGGAAAATGGAGAAGAA |
| | | TTAAATGCTACCAACACAACACTGTCCCAAGATCCTCAAACCAAGCTCTACATGATTAGCA |
| | | GTGAACTGGATTTCAACATGACAAGCAATCACACCTTCTTGTGTCTTGTCAAGTATGGAGA |
| | | CTTAACAGTGTCACAGACCTTCTACTGGCAAGAATCCAAACCAACCCCTTCTGCTAATCAG |

| SEQ ID | Clone ID Name | Sequence |
|---|---|---|
| | | CACCTGACCTGGACCATTATTATCCCGGTCTCAGCATTTGGGATTTCTGTGATCATTGCAG |
| | | TTATACTAACATGCCTGACCTGCAGAAATGCTGCAATACGCAGACAGAGAAGGGAGAATGA |
| | | AGTGGAAATGCAAAGTTGCTCTCAGTCTCCATAG |
| SEQ ID NO:260 | Round 2 CTLA4 A-F10-1 | ATGGGTCACACAATGAAGTGGGGATCACTACCACCCAAGCGCCCATGCCTCTGGCTCTCTC AGCTCTTGGTGCCCACTGGTCTTTTTTACTTCTGTTCAGGTATCACCCCAAAGAGTGTGAC CAAAAGAGTGAAAGAAACAGTAATGCTATCCTGTGATTACAACACATCCACTGAAGAACTG ACAAGCCTTCGGATCTATTGGCAAAAGGATAGTAAAATGGTGCTGGCCATCCTGCCTCGAA AAGTGCAGGTGTGGCCTGAGTACAAGAACCGCACCATCACTGACATGAACGATAACCCCCG TATTGTGATCCTGGCTCTGCGCCTGTCGGACAAGGGCACCTACACCTGCGTGGTTCAGAAG AATGAGAACGGGTCTTTCAGACGGGAGCACCTGACCTCCGTGACACTGTCCATCAGAGCTG ACTTCCCTGTCCCTACCATAAATGATCTTGGAAATCCATCTCCTAATATCAGAAGGCTAAT TTGCTCAACCTCTGGAGGTTTTCCAAGGCCCCACCTCTACTGGTTGGAAAATGGAGAAGAA TTAAATGCTACCAACACAACACTGTCCCAAGATCCTGAAACCAAGCTCTACATGATTAGCA GTGAACTGGATTTCAACATGACAAGCAATCACAGCTTCTTGTGTCTTGTCAAGTATGGAGA CTTAACAGTGTCACAGACCCTCTACTGGCAAGAATCCAAACCAACCCCTTCTGCTAATCAG CACCTGACCTGGACCATTATTATCCCAGTCTCAGCATTTGGGATTTCTGTGATCATTGCAG TTATACTAACATGCCTGACCTGCAGAAATGCTGCAATACGCAGACAGAGAAGGGAGAATGA AGTGGAAATGCAAAGTTGCTCTCAGTCTCCATGA |
| SEQ ID NO:261 | Round 2 CTLA4 A-G8-1 | ATGGGTCACACAGTGAAGTGGGGATCACTACCACCCAAGCGCCCATGCCTCTGGCTCTCTC AGCTCTTGGTGCTCACTGGTCTTTTTTACTTCTGTTCAGGCATCACCCCAAAGAGTGTGAC CAAAAGAGTGAAAGAAACAGTAATGCTATCCTGTCATTACAACACATCCACTGAAGAACTG ACAAGCCTTCGGATCTATTGGCAAAAGGATAGTAAAATGGTGCTGGCCATCCTGCCTGGAA AAGTGCACGTCTGGCCTGAGTACAAGAACCGCACCATCACTGACATGAACCATAACCCCCC TATTGTGATCCTGGCTCTGCCCCTGTCGGACAGTGGCACCTACACCTGTGTTATTCAGAAG CCTGATTTGAAAGGGCTTATAAACTGGAGCACCTGACTTCCGTGAGGTTAATGATCAGAG CTGACTTCCCTGTCCCTACCATAAATGATCTTGGAAATCCATCTCCTAATATCAGAAGGCT AATTTGCTCAACCTCTCGACCTTTTCCAAGGCCCCACCTCTACTCGTTGGAAAATGGAGAA GAATTAAATGCTACCAACACAACACTGTCCCAAGATCCTCAAACCAAGCTCTACATGATTA GCAGTGAACTGGATTTCAACATGACAAGCAATCACAGCTTCTTGTGTCTTGTCAAGTATGG AGACTTAACAGTGTCACAGACCTTCTACTGGCAAGAATCCAAACCAACCCCTTCTGCTAAT CAGCACCTGACCTGGACCATTATTATCCCAGTCTCAGCATTTGGGATTTCTGTGATCATTG CAGTTATACTAACATGCCTGACCTGCAGAAATGCTGCAATACCCAGACAGAGAAGGGAGAA TGAAGTGGAAATGCAAAGTTGCTCTCAGTCTCCATGA |
| SEQ ID NO:262 | Round 2 CTLA4 A-C9-9 | ATGGGTCACACAATGAAGTGGGGATCACTACCACCCAAGCGCCCATGCCTCTGGCTCTCTC AGCTCTTGGTGCTCACTGGTCTTTTTTACTTCTGTTCAGGCATCACCCCAAAGAGTGTGAC CAAAAGAGTGAAAGAAACAGTAATGCTATCCTGTGATTACAGCACATCCACTGAAGAACTG ACAAGCCTTCGGATCTATTGGCAAAAGGATAGTAAAATGGTGCTGGCCATCCTGCCTGGAA |

-continued

SEQUENCES

| SEQ ID | Clone ID Name | Sequence |
|---|---|---|
| | | AAGTGCAGGTGTGGCCTGAGTACAAAAACCGCACCTTCCCCGACATCATTAACAACCTCTC |
| | | CCTTATGATCCTCGCACTCCGCCTGTCGGACAGGGGCACCTACACCTGCGTGGTTCAGAAG |
| | | AATGAGAACGGGTCTTTCAGACGGGAGCACCTGACCTCCGTGACACTGTCCATCAGACCTG |
| | | ACTTCCCTGTCCCTAGCATAACTGACATTGGACATCCCGCCCCTAATGTGAAAAGGATAAG |
| | | ATGCTCCGCCTCTGGAGGTTTTCCAGAGCCTCGCCTCGCCTGGATGGAAGATGGAGAAGAA |
| | | CTAAACCCCGTCAACACGACGGTTGACCAGCATTTGGACACGGAGCTCTACAGCGTCGGCA |
| | | GTGAACTGGATTTCAATGTGACAAATAACCACAGCATCGTGTGTCTCATCAAATACGGGGA |
| | | CCTGTCGGTGTCACAGATCTTCCCTTGGAGCAAACCCAAGCAGGAGCCTCCCATTGATCAG |
| | | CTTCCATTCTGGGTCATTATCCCAGTAAGTGGTCCTTTGGTGCTCACTGCGGTAGTTCTCT |
| | | ACTGCCTGGCCCGCAGACATGTTGCGAGGTGGAAAAGAACAAGAAGGAATGAAGAGACAGT |
| | | GGGAACTGAAAGGCTGTCCCCTATCTACTTAGGCTCTGCGCAATCCTCGGGCTGAG |
| SEQ ID NO:263 | Round 2 CTLA4 A-H3-6 | MGHTLRPGTPLPRCLHLKLCLLLALAGLHFSSGISQVTKSVKEMAALSCDYNISIDELARM RIYWQKDQQMVLSIISGQVEVWPEYKNRTFPDIINNLSLMILALRLSDKCTYTCVVQKNEN GSFRREHLTSVTLSIRADFPVPSINDLGNPSPNIRRLICSTSGGFPRPHLYWLENGEELNA TNTTLSQDPETKLYMISSELDFNMTSNHSFLCLVKYGDLTVSQTFYWQESKPTPSANQHLT WTIIIPVSAFGISVIIAVILTCLTCRNAAIRRQRRENEVEMQSCSQSP |
| SEQ ID NO:264 | Round 2 CTLA4 A-B11-5 | MGHTMEWGSLPPKRPCLWLSQLLVLTGLFYFCSGITPKSATKRvKETVMLSCDYSTSTEEL TSLRIYWQKDSKNVLAILPGKVQVWPEYKNRTITDMNDNPRIVILALRLSDSCTYTCVIQK PDLKGAYKLEHLTSVRLMIRADFPVPTTNDLGNPSPNIRRLTCSTSGGFPRPHLYWLENCE ELNATNTTLSQDPETKLYMISSELDFNMTSNHSFLCLVKYGDLTVSQTFYWQESKPTPSAN QHLTWTIIIPVSAFGISVIIAVILTCLTCRNAAIRRQRRENEvEMQSCSQSp |
| SEQ ID NO:265 | Round 2 CTLA4 A-E2-6 | MGHTMKWGSLPPKRPCLWLSQLLVLTGLFYFCSGITPKSVTKRVKETVMLSCDYNTSTEEL TSLRIYWQKDSKMVLAILPGKVQVWPEYKNRTITDMNDNPRTVILALRLSDSGTYTCVVQK NENGSFRREHLTSVRLMIRADFPVPTINDLGNPSPNILRRLICSTSGGFPRPHLYWLENGEE LNATNTTLPQDPETKLYMISSELDFNMTSNHSFLCLVKYGDLTVSQTFYWQESKPTPSANQ HLTWTIIIPVSAFGISVIIAVILTCLTCRNAAIRRQRRENEVEMQSCSQSP |
| SEQ ID NO:266 | Round 2 CTLA4 A-F1-6 | MGHTMKWGSLPPKRPCLWLSQLLVLTGLFYFCSGITPKSVTKRVKETVMLSCDYSTSTEEL TSLRIYWQKDSKNVLAILPGKVQVWPEYKNRTITDMNDNPRIVILALRLSDKGTYTCVVQK NENGSFRREHLTSVRLMIRADFPVPTINDLGNPSPNIRRLICSTSGGFPRPHLYWLENGEE LNATNTTLSQDPETKLYMISSELDFNMTSNHSFLCLVKYGDLTVSQTFYWQESKPTPSANQ HLTWTIIIPVSAFGISVIIAVILTCLTCRNAAIRRQRRENEVENQSCSQSP |
| SEQ ID NO:267 | Round 2 CTLA4 A-F6-9 | MGHTMKWGSLPPKRPCLWLSQLLVLTGLFYFCSGITPKSVTKRVKETVMLSCDYSTSTEEL TSLRIYWQKDSKMVLAILPGKVQVWPEYKNRTITDMNDNPRIVILALRLSDSGTYTCVIQK PDLKGAYKLEHLTSVRLMIRADFPVPTINDLGNPSPNIRRLICSTSGGFPRPHLYWLENCE ELNATNTTLSQDPETKLYMISSELDFNMTSNHSFLCLVKYGDLTVSQTFYWQESKPTPSAN QHLTWTIIIPVSAFGISVIIAVILTCLTCRNAAIRRQRRENEVEMQSCSQSP |

-continued

SEQUENCES

| SEQ ID | Clone ID Name | Sequence |
|---|---|---|
| SEQ ID NO:268 | Round 2 CTLA4 A-H4-5* | MGHTMKWGSLPPKRPCLWLSQLLVLTGLFYFCSGITPKSVTKRVKETVMLSCDYSTSTEEL TSLRIYWQKDSKMVLAILPGKVQVWPEYKNRTITDMNDNPRTVILALRLSDKGTYTCVVQK NENGSFRREHLTSVTLSIRADFPVPSITDIGHPAPNVKRTRCSASGGFPEPRLYWLENGEE LNATNTTVSQDPGTELYNISSELDFNVTNNHSTVCLIKYGELSVSQIFPWSKPKQEPPIDQ LPFWVIIPVSGALVLTAVVLYCLACRHVARWKRTRRNEETVGTERLSPTYLGSAQSSG |
| SEQ ID NO:269 | Round 2 CTLA4 A-B4-6 | MDHTMKWGSLFFKRPCLWLSQLLVLTGLFYFCSGTTPKSVTKRVKETVMLSCDYNTSTEEL TSLRIYWQKDSKMVLAILPGKVQVWPEYKNRTITDMNDNPRIVILALRLSDKGTYTCVVQK NENGSFRREHLTSVTLSIEADFPVPTINDLGNPSPNIRRLICSTSGGFPRPHLYWLENGEE LNATNTTLSQDPETKLYMISSELDFNMTSNHSFLCLVKYGDLTVSQTFYWQESKPTPSANQ HLTWTIIIPVSAFGISVIIAVILSTCLTCRNAAIRRQRRENEVENQSCSQSP |
| SEQ ID NO:270 | Round 2 CTLA4 A-F10-1 | MGHTMKWGSLPPKRPCLWLSQLLVPTGLFYFCSGTTPKSVTKRVKETVMLSCDYNTSTEEL TSLRIYWQKDSKMVLAILPGKVQVWPEYKNRTITDMNDNPRTVILALRLSGKGTYTCVVQK NENGSFRREHLTSVTLSIRADFPVPTINDLGNPSFNIRRLICSTSGGFPRPHLYWLENGEE LNATNTTLSQDPETKLYMTSSELDFNNTSNHSFLCLVKYGDLTVSQTLYWQESKPTPSANQ HLTWTIIIPVSAFGISVITAVILTCLTCRNAAIRRQRRENEVEMQSCSQSP |
| SEQ ID NO:271 | Round 2 CTLA4 A-G8-1 | MGHTVKWGSLPPKRPCLWLSQLLVLTGLFYFCSGITPKSVTKRVKETVMLSCDYNTSTEEL TSLRIYWQKDSKNVLAILPGKVQVWPEYKNRTITDMNDNPRIVILALPLSDSQTYTCVIQK PDLKGAYKLEHLTSVRLMIRADFPVPTINDLGNPSPNIRRLICSTSGGFPRPHLYWLENGE ELNATNTTLSQDPETKLYMISSELDFNNTSNHSFLCLVKYGDLTVSQTFYWQESKPTPSAN QHLTWTIIIPVSAFGISVIIAVILTCLTCRNAAIRRQRRENEVENQSCSQSP |
| SEQ ID NO:272 | Round 2 CTLA4 A-C9-9 | MGHTMKWGSLPPKRPCLWLSQLLVLTGLFYFCSGITFKSVTKRVKETVMLSCDYSTSTEEL TSLRIYWQKDSKMVLAILPGKVQVWPEYKNRTFPDIINNLSLMILALRLSDRGTYTCVVQK NENGSFRREHLTSVTLSIRADFPVPSITDIGHPAPNVKRIRCSASGGFPEPRLAWMEDGEE LNAVNTTVDQDLDTELYSVGSELDFNVTNNHSIVCLIKYGELSVSQIFPWSKFKQEPPIDQ LPFWVIIPVSGALVLTAVVLYCLARRHVARWKRTRRNEETVGTERLSPIYLGSAQSSG |
| SEQ ID NO:273 | Human B7-1 | ATCCGCCACACACGGAGGCAGCGAACATCACCATCCAAGTGTCCATACCTCAATTTCTTTC AGCTCTTGGTGCTGGCTGGTCTTTCTCACTTCTGTTCAGGTGTTATCCACGTGACCAACGA AGTGAAAGAAGTGGCAACGCTGTCCTGTGGTCACAATGTTTCTGTTGAAGACCTGGCACAA ACTCGCATCTACTGGCAXU&GGAGAAGAAAATCCTGCTCACTATGATGTCTGGGGACATGA ATATATGGCCCGAGTACAACAACCGGACCATCTTTCATATCACTAATAACCTCTCCATTCT GATCCTGGCTCTGCQCCCATCTGACGACGGCACATACGAGTGTGTTCTTCTCAAGTATGAA AAACACCCTTTCAAGCCGGAACACCTGCCTGAAGTGACGTTATCAGTCAAAGCTGACTTCC CTACACCTAGTATATCTGACTTTGAAATTCCAACTTCTAATATTAGAAGCATAATTTGCTC AACCTCTGGAGGTTTTCCTGAGCCTCACCTCTCCTGGCTGGAAAATGGAGAAGAATTAAAT GCCATCAACACAACAGTTTCCCAAGATCCTGAAACTGAGCTCTATGCTGTTACCAGCAAAC TGGATTTCAATATGACAACCAACCACAGCTTCATGTGTCTCATCAAGTATGGACATTTAAG AGTGAATCAGACCTTCAACTGGAATACAACCAAGCAAGAGCATTTTCCTGATAACCTGCTC |

-continued

SEQUENCES

| SEQ ID | Clone ID Name | Sequence |
|---|---|---|
| | | CCATCCTGCGCCATTACCTTAATCTCAGTAAATGGAATTTTTGTGATATGCTGCCTCACCT |
| | | ACTGCTTTCCCCCAAGATGCAGAGAGAGAAGGAGGAATGAGACATTGAGAAGGGAAAGTGT |
| | | ACGCCCTGTATGA |
| SEQ ID NO:274 | Rhesus B7-1 | ATGGGCCACACACGQAGGCAGGAAATATCACCATCCAAGTGTCCATACCTCAACTTCTTTC |
| | | AGCTCTTGGTGCTGGCTTGTCTTTCTCATTTCTGTTCAGGTGTTATCCACCTGACCAAGGA |
| | | AGTGAAAGAAGTGGCAACGCTGTCCTGTGGTCACAATGTTTCTGTTGAAGAGCTCGCACAA |
| | | ACTCGCATCTACTGGCAAAAGGAGAAGAAATGGTCCTGACTATGATGTCTCGGGACATGA |
| | | ATATATGGCCCGAGTACAAGAACCGGACCATCTTTGATATCACAAATAACCTCTCCATTGT |
| | | GATTCTGGCTCTGCGCCCATCTCACGAGGGCACATACGAGTGTGTTGTTCTGAAGTATGAA |
| | | AAAGATGCTTTCAAGCCGGAACACCTGGCTGAAGTGATGTTATCCGTCAAAGCTGACTTCC |
| | | CTACACCTAGTATAACTGACTCTGAAATTCCACCTTCTAACATTAGAAGGATAATTTGCTC |
| | | AAACTCTGGACGTTTTCCAGAGCCTCACCTCTCCTGCTTGGAAAATGGAGAAGAATTAAAT |
| | | GCCATCAGCACAACAGTTTCCCAAGATCCTGAAACTGACCTCTATACTGTTAGCAGCAAAC |
| | | TGGATTTCAATATGACAACCAATCACAGTTTCATCTGTCTCATCAAGTATGGACATTTAAG |
| | | AGTGAATCAGACCTTCAACTGGAACACACCCAAGCAAGAGCATTTTCCTGATAACCTGCTC |
| | | CCATCCTCGGCCATTATCCTAATCTCAGTAAATGGAATTTTTGTGATATGCTGCCTGACCT |
| | | ACTGTTTTGCCCCAAGGTGCAGAGAGAGAAGAAGGAATGAGACATTGAGAAGGGAAAGTGT |
| | | ACGCCCTGTATGA |
| SEQ ID NO:275 | Bovine B7-1 (cow) | ATGGGTCACACAATCAAGTGGGGAACACTACCACCCAAGCGCCCATGCCTCTGGCTCTCTC |
| | | AGCTCTTGCTGCTCACTGGTCTTTTTTACTTCTGTTCAGGCATCACCCCLAAGAGTGTGAC |
| | | CAAAAGAGTGAAAGAAACAGTAATGCTATCCTGTGATTACAACACATCCACTGAAGAACTC |
| | | ACAAGCCTTCGGATCTATTGGCAAAAGGATAGTAAAATGGTGCTGGCCATCCTCCCTGGAA |
| | | AAGTGCAGGTGTGGCCTGAATACAAGAACCGCACCATCACTGACATGAACGATAACCCCCG |
| | | CATTGTGATCCTGGCTCTGCGCCTGTCGGACAGTGGCACCTACACCTGTGTTATTCAGAAG |
| | | CCTGATTTGAAAGGGCTTATAAACTGGAGCACCTGACTTCCGTGAGGTTAATGATCAGAG |
| | | CTGACTTCCCTGTCCCTACCATAAATGATCTTGGAAATCCATCTCCTAATATCAGAAGGCT |
| | | AATTTGCTCAACCTCTGGAGGTTTTCCAAGGCCCCACCTCTACTGGTTGGAAAATGGAGAA |
| | | GAATTAAATGCTACCAACACAACACTGTCCCAAGATCCTGAAACCAAGCTCTACATGATTA |
| | | GCAGTGAACTGGATTTCAACATGACAAGCAATCACAGCTTCTTGTGTCTTGTCAAGTATGG |
| | | AGACTTAACAGTGTCACAGACCTTCTACTGGCAAGAATCCAAACCAACCCCTTCTGCTAAT |
| | | CAGCACCTGACCTGGACCATTATTATCCCAGTCTCAGCATTTGGGATTTCTGTGATCATTG |
| | | CAGTTATACTAACATGCCTGACCTGCAGAAATGCTGCAATACGCAGACAGAGAAGGGAGAA |
| | | TGAAGTGGAAATGGAAAGTTGCTCTCAGTCTCCA |
| SEQ ID NO:276 | Rabbit B7-1 | ATGGGCCACACGCTGAGGCCGGGAACTCCACTGCCCAGGTGTCTACACCTCAAGCTCTGCC |
| | | TGCTCTTGGCCCTGGCGCGTCTCCACTTCTCTTCAGGTATCAGCCAGGTCACCAAGTCGGT |
| | | GAAAGAAATGCCAGCACTGTCCTGTGATTACAACATTTCTATCGATGAACTGGCGAGAATG |
| | | CGCATATACTGGCACAACGACCAACAGATGGTGCTGAGCATCATCTCTGGGCAAGTGGAAG |

-continued

SEQUENCES

| SEQ ID | Clone ID Name | Sequence |
|---|---|---|
| | | TGTGGCCTGAGTACAAGAACCGCACCTTCCCCGACATCATTAACAACCTCTCCCTTATGAT |
| | | CCTGGCACTGCGCCTGTCGGACAAGGCCACCTACACCTGCGTGGTTCAGAAGAATGAGAAC |
| | | GGGTCTTTCAGACGGGAGCACCTCACCTCCGTGACACTGTCCATCAGAGCTGACTTCCCTG |
| | | TCCCTAGCATAACTGACATTGGACATCCCGACCCTAATGTGAAAAGGATAAGATGCTCCGC |
| | | CTCTGGAGGTTTTCCAGAGCCTCGCCTCGCCTGGATGGAAGATGGAGAAGAACTAAACGCC |
| | | GTCAACACGACGGTTGACCAGGATTTGGACACGGAGCTCTACAGCGTCAGCAGTGAACTCC |
| | | ATTTCAATGTGACAAATAACCACAGCATCGTGTGTCTCATCAAATACGGGGAGCTGTCGGT |
| | | GTCACAGATCTTCCCTTGGAGCAAACCCAAGCAGCAGCCTCCCATTGATCAGCTTCCATTC |
| | | TGGGTCATTATCCCAGTAAGTGGTGCTTTGGTGCTCACTGCGGTAGTTCTCTACTGCCTGG |
| | | CCTGCAGACATGTTGCGACGTGGAAAAGAACAAGAAGGAATGAAGAGACAGTGCGAACTGA |
| | | AAGGCTGTCCCCTATCTACTTAGGCTCTGCGCAATCCTCGGGCTGA |
| SEQ ID NO:277 | Cat B7-1 | ATGGGTCACGCAGCAAAGTGGAAAACACCACTACTGAAGCACCCATATCCCAAGCTCTTTC |
| | | CGCTCTTGATGCTAGCTACTCTTTTTTACTTCTGTTCAGGTATCATCCAGGTGAACAAGAC |
| | | AGTGGAAGAAGTAGCAGTACTATCCTGTGATTACAACATTTCCACCAAAGAACTCACGGAA |
| | | ATTCGAATCTATTGGCAAAAGGATGATGAAATGGTGTTGGCTGTCATGTCTGGCAAAGTAC |
| | | AAGTGTGGCCCAAGTACAAGAACCGCACATTCACTGACGTCACCGATAACCACTCCATTGT |
| | | GATCATCGCTCTGCGCCTGTCAGACAATGGCAAATACACTTGTATTATTCAAAAGATTGAA |
| | | AAACGGTCTTACAAAGTGAAACACCTGACTTCGGTGATCTTATTGCTCAGACCTGACTTCC |
| | | CTGTCCCTAGTATAACTGATCTTGGAAATCCATCTCATAACATCAAAAGGATAATGTGCTT |
| | | AACTTCTGGAGGTTTTCCAAAGCCTCACCTCTCCTGGCTGGAAAATGAAGAAGAATTAAAT |
| | | GCCATCAACACAACAGTTTCCCAAGATCCTCAAACTGACCTCTACACTATTACCAGTGAAC |
| | | TGGATTTCAATATGACAAACAACCATAGCTTCCTGTGTCTTGTCAAGTATGGAAACTTACT |
| | | AGTATCACAGATCTTCAACTGGCAAAAATCAGAGCCACAGCCTTCTAATAATCAGCTCTGG |
| | | ATCATTATCCTGAGCTCAGTAGTAAGTGGGATTGTTGTGATCACTGCACTTACCTTAAGAT |
| | | GCCTAGTCCACAGACCTGCTGCAAGGTGGAGACAAAGAGAAATGGGGAGAGCGCGGAAATG |
| | | GAAAAGATCTCACCTGTCTACATAGATTCTGCACAACCACTGTATGCAGAGCATCTGGAGG |
| | | TAGCCTCTTTAGCTCTTCTCTACTAG |
| SEQ ID NO:278 | Human B7-1 | MGHTRRQGTSPSKCPYLNFFQLLVLAGLSHFCSGVIHVTKEVKEVATLSCGHNVSVEELAQ |
| | | TRIYWQKEKKNVLTMMSGDMNIWPEYKNRTIFDITNNLSIVILALRPSDEGTYECVVLKYE |
| | | KDAFKREHLAEVTLSVKADFPTPSISDFEIPTSNIRRIICSTSGGFPEPHLSWLENGEELN |
| | | AINTTVSQDPETELYAVSSKLDFNMTTNHSFMCLIKYGHLRVNQTFNWNTTKQEHFPDNLL |
| | | PSWAITLISVNGIFVICCLTYCFAPRCRERRRNERLRRESVRPV |
| SEQ ID NO:279 | Rhesus B7-1 | MGHTRRQGISPSKCPYLKFFQLLVLACLSHLCSGVIHVTKEVKEVATLSCGHNVSVEELAQ |
| | | TRIYWQKEKKNVLTMNSGDMNIWPEYKNRTIFDITNNLSIVILALRPSDEGTYECVVLKYE |
| | | KDAFKREHLAEVMLSVKADFPTPSITDFEIPPSNTRRIICSTSGGFPEPRLSWLENGEELN |
| | | AISTTVSQDPETELYTVSSKLDFNMTTNHSFNCLIKYCHLRVNQTFNWNTPKQEHFPDNLL |
| | | PSWAITLISVNCIFVICCLTHCFAPRCRERRRNETLRRESVRPV |

-continued

SEQUENCES

| SEQ ID | Clone ID Name | Sequence |
|---|---|---|
| SEQ ID NO:280 | Bovine B7-1 | MGHTMKWGSLPPKRPCLWLSQLLVLTGLFYFCSGITPKSVTKRVKETVNLSCDYNTSTEEL TSLRIYWQKDSKNVLAILFGKVQVWPEYKNRTITDMNDNPRIVILALRLSDSGTYTCVIQK PDLKCAYKLEHLTSVRLMIRADFPVPTINDLGNFSPNIRRLICSTSGGFPRFHLYWLENGE ELNATNTTLSQDPETKLYMISSELDFNMTSNHSFLCLVKYGDLTVSQTFYWQESKPTPSAN QHLTWTIIIPVSAFGISVIIAVILTCLTCRJAAIRRQRRENEVEMQSCSQSP |
| SEQ ID NO:281 | Rabbit B7-1 | MGHTLRPGTPLPRCLHLKLCLLLALACLHFSSGISQVTKSVKENAALSCDYNISIDELARM RIYWQKDQQMVLSTISGQVEWPEYKNRTFPDIINTYLSLMILALRL5DKGTYTCVVQKNEN GSFRREHLTSVTLSIRADFPVPSTTDIGHPAPNVKRIRCSASGGFPEPRLAWMEDGEELNA VNTTVDQDLDTELYSVSSELDFNVTNNHSIVCLIKYGELSVSQIFPWSKPKQEPPIDQLPF WVIIPVSGALVLTAVVLYCLACRHVARWKRTRRNEETVGTERLSPIYLGSAQSSG |
| SEQ ID NO:282 | Cat B7-1 | MGHAAKWKTPLLKHPYPKLFPLLMLASLFYFCSCIIQVNKTVEEVAVLSCDYNISTKELTE IRIYWQKDDEMVLAVMSGKVQVWPKYKNRTFTDVTDNHSIVIMALRLSDNGKYTCIIQKIE KCSYKVKHLTSVMLLVRADFPVPSITDLCNFSHNIKRTMCLTSCGFPKPHLSWLENEEELN AINTTVSQDPETELYTISSELDFNMTNNHSFLCLVKYGNLLVSQIFNWQKSEPQPSNNQLW IIILSSVVSGIWITALTLRCLVHRPAARWRQREMGRARKWKRSHLST |
| SEQ ID NO:283 | CD28BP Consensus | MGHTMKWGSLPPKRPCLWLSQLLVLTGLFYFCSGITPSKVTKRVKETVMLSCDYNTSTEEL TSLRIYWQKDSKMVLAILPGKVQVWPEYKNRTITDMNDNPRIVILALRLSDSGTYTCVIQK PVLKGAYKLEHLASVRLMIRADPPVPTINDLGNPSPNIRRLICSTSGCFPRPHLYWLENGE ELNATNTTVSQDPDTELYMISSELDFNVTNNHSIVCLIKYGELSVSQIFFWSKPKQEPPID QLPFWVIIPVSGALVLTAVVLYCLACRHVARWKRTRRNEETVGTERLSPIYLGSAQSSG |
| SEQ ID NO:284 | CD28BP CGformC | MGHTMXWXSLPPKXPCLXXXQLLVLTXLFYFCSGITPKSVTKRVKETVMLSCDYXTSTEXL TSLRIYWXKDSKMVLAILPGKVQVWPEYKNRTITDNNDNXRIVIXALRXSDXCTYTCVXQK PXLKGAYKLEHLXSVRLMIRADFPVPXXXDLGNPSPNIRRLICSXXXGFPRPHLXWLENGE ELNATNTTXSQDPXTXLYMISSELXFNVTNNXSIXCLIKYGELXVSQIFPWSKPKQEPPID QLPFXVIIPVSGALVLXAXVLYXXACRHXARWKRTRRNEETVGTERLSPIYLGSAQSSG |
| SEQ ID NO:285 | CD28BP CG1c | MGHTNKWRSLPPKRPCLWPSQLLVLTDLFYFCSGITPKSVTKRVKETVMLSCDYNTSTEEL TSLRIYWQKDSKMVLAILPGKVQVWPEYKNRTITDMNDNPRIVILALRPSDKGTYTCVVQK PVLKGAYKLEHLTSVRLNIRADFPVPTINDLGNPSPNIRRLICSTSGGFPRPHLCWLENGE ELNATNTTVSQDPGTELYMISSELGFNVTNNHSIACLIKYCELSVSQIFPWSKPKQEPPID QLPFWVIIPVSGALVLAAVVLYRPACRHGARWKRTRENEETVGTERLSPIYLGSAQSSG |
| SEQ ID NO:286 | CTLA4BP Consensus | MGHTRRQGISPSKCPYLKFEQLLVLACLSHFCSGVIHVTKEVKEVATLSCGHNVSVEELAQ TRIHWQKEKKMVLTMMSGDMNIWPEYKNRTIFDITNNLSIVILALRPSDEGTYECVVLKYE KDAFKREHLAEVMLSVKADFPTPSISDFEIPPSNIRRIICSTSGGFPEPHLSWLENGEELN AINTTVSQDPETELYTVSSKLDFNMTTNHSENCLIKYGHLRVNQTFNWNTPKQEHFPDNLL PSWAITLISVNGIFVICCLTYCFAPRCRERRRNERLRRESVRPV |
| SEQ ID NO:287 | CTLA4BP CGform | MGHTRRQCTSPXKCPYLKFFQLLVXACLXHLCSGVIHVTXEVKEVATLSCGLNVSVEELAQ TRIHWQKEKKNVLTMMSGDMNIWPEYKNRTIFDITNNLSIVILALRPSDEGTYECVVLKYX |

-continued

SEQUENCES

| SEQ ID | Clone ID Name | Sequence |
|---|---|---|
| | | KDAFKRXHLAEVMLSVKADFPTPSITDFEIPPSNIRRIICSXSGGEPEPHLEWLENGEELN |
| | | AINTTVSQDPETXLYTVSSKLDFNMTANHSFMCLIXYGHLRVNQTFNWNTPKQEHFPXNLL |
| | | PSWAITLISANCIFVICCLTYRFAPRCRERKSNETLRRESVCPV |
| SEQ ID NO:288 | CTLA4BP CG1 | MGHTRRQGTSPPECPYLKFFQLLVNACLPHLCSGVIEVTREVKEVATLPCGLNVSVEELAQ |
| | | TPIHWQKEKKMVLTMMSGDMNIWPEYKNRTIFDITNNLSIVILALRPSDEGTYECVVLKYD |
| | | KDAFKQKHLAEVMLSVKADFPTPSITDFEIPPSNIKRIICSASGGFPEPHLFGLENGEEIN |
| | | AINTTVSQDPETGLYTVSSKLDFNNTADHNFNCLIRYGHLRVNQTENWNTPKQEHFPNNPL |
| | | PSWAITLISANGIFVICCPTYRFAPGCRERKSNETLRRESVCPV |
| SEQ ID NO:289 | CTLA4BP CG2 | MGHTRRQGTSPSKCPYLKFFQLLVLACLSHLCSGVIHVTKEVKEVATLSCGLNVSVEELAQ |
| | | TRIHWQKEKKNVLTMNSGDWTIWPEYKIJRTIEDITNNLSIVILALRPSDEGTYECWLKYE |
| | | KDAFKREHLAEVMLSVKADFPTPSITDFEIPPSNIRRIICSTSGCFPEPHLFWLENCEELN |
| | | AINTTVSQDPETELYTVSSKLDFNNTANHSFMCLIKYGHLRVNQTFNWNTFKQEHFPDNLL |
| | | PSWAITLISANGIFVICCLTYRFAPRCRERKSNETLRRESVCPV |
| SEQ ID NO:290 | CD28BP CCformD | MGHTMKWGSLPPKRPCLWLSQLLVLTGLFYFCSCITPKSVTKRVKETVMXSCDYXXSTEEL |
| | | TSLRIYWQKDSKMVLAILPGKVQVWPEYKNRTITDMNDNPRIVILALRLSDXCTYTCVXQK |
| | | XXXXCXXXXEHLXSVXLXIRADFPVPSITDIGHPAPNVKRIRCSASGXFPEPRLAWNEDGE |
| | | ELNAVNTTVXXXLDTELYSVSSELDXNXTNNHSIVCLIKYGELSVSQIFPWSKPKQEPPID |
| | | QLPFWVIXXVSGALVLTAWLYCLACRIWAR |
| SEQ ID NO:291 | CD28BP CG1d | MGHTMKWGSLPPKRPCLWLSQLLVLTGLFYFCSGITPKSVTKRVKETVMLSCDYNASTEEL |
| | | TSLRIYWQKDSKNVLAILPGKVQVWPEYKNRTITDMNDNPRIVILALRLSDSGTYTCVIQK |
| | | PVLKGAYKLEHLASVRLMIPADFPVPSITDICHPAPNVKRIRCSASGDEPEPRLAWMEDGE |
| | | ELNAVNTTVDQDLDTELYSVSSELDSNVTNNHSIVCLTKYGELSVSQIFPWSKPKQEPPID |
| | | QLPFWVIILVSGALVLTAVVLYCLACRHVAR |
| SEQ ID NO:292 | CD28BP CGformB | MGHTMKWGXLPPKRPCLWLSQLLVLTGLFYFCSGXTPKSVTKRVKETVMLSCDYXTSTEEL |
| | | TSLRIYWQKDSKMVLAILPGKVQVWPEYKNRTITDMNDNPRIVILALRXSDSGTYTCVIQK |
| | | PXLKGAYKLEHLXSVRLNIRADFPvPTINDLGNPSPNIRRLICSTSGGFPRPHLYWLENGX |
| | | ELNATNTTXSQDPETKLYMISSELDFNXTSNXXXLCLVKYGDLTVSQXFYWQESKPTPSAN |
| | | QHLTWTIIIPVSAPGISVTTAVTLTCLTCRNAATRRQRRENEVXMXSCSQSP |
| SEQ ID NO:293 | CD28BP CG1b | MGHTMKWGTLPPKRPCLWLSQLLVLTGLFYFCSGITPKSVTKRVKETVMLSCDYNTSTEEL |
| | | TSLRIYWQKDSKNVLAILPGKVQVWPEYKNRTITDMNDNPRIVTLALRLSDSGTYTCVIQK |
| | | PDLKGAYKLEHLTSVRLMIRADFPVPTINDLGNPSPNIRRLICSTSGGFPRPHLYWLENGK |
| | | ELNATNTTLSQDPETKLYMISSELDPNNTSNHSFLCLVKYGDLTVSQTFYWQESKPTPSAN |
| | | QHLTWTIIIPVSAFGISVTTAVILTCLTCRNAAIRRQRRENEVKNESCSQSP |

SEQUENCE LISTING (312 sequences)

SEQ ID NO: 1 - DNA, 891 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaacatgacaagcaatcacagcttcttgtgtcttgtcaagtatggagacttaacagtgtcacagaccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtggaaatgcaaagttgctctcagtctccatga

SEQ ID NO: 2 - DNA, 900 bp, Artificial Sequence
  Description of Artificial Sequence: Synthetic nucleotide sequence
atgggccacacgctgaggccgggaactccactgcccaggtgtctacacctcaagctctgcctgctcctggcgctggcgggtctccacttctcttcaggtatcagccaggtcaccaagtcggtgaaagaaatggcagcactgtcctgtgattacaacatttctatcgatgaactggcgagaatgcgcatatactggcagaaggaccaacagatggtgctgagcatcatctctgggcaagtggaagtgtggcctgagtacaagaaccgcaccttccccgacatcattaacaacctctcccttatgatcctggcactgcgcctgtcggacaagggcacctacacctgcgtggttcagaagaatgagaacgggtctttcagacgggagcacctgacctccgtgacactgtccatcagagctgactcccctgtccctagcataactgacattggacatcccgcccctaatgtgaaaaggataagatgctccgcctctggaggttttccagagcctcgcctcgcctggatggaagatggagaagaactaaacgccgtcaacacgacggttgaccaggatttggacacggagctctacagcgtcagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 3 - DNA, 900 bp, Artificial Sequence
  Description of Artificial Sequence: Synthetic nucleotide sequence
atgggccacacgctgaggccgggaactccactgcccaggtgtctacacctcaagctctgcctgctcttggcgctggcgggtctccacttctcttcaggtatcagccaggtcaccaagtcggtgaaagaaatggcagcactgtcctgtgattacaacatttctatcgatgaactggcgagaatgcgcatatactggcagaaggaccaacagatggtgctgagcatcatctctgggcaagtggaagtgtggcctgagtacaaaaaccgcaccttccccgacatcattaacaacctctcccttatgatcctggcactgcgcctgtcggacaagggcacctacacctgcgtggttcagaagaatgagaacgggtctttcagacgggagcacctgacctccgtgacactgtccatcagagctgacttccctgtccctagcataactgacattggacatcccgcccctaatgtgaaaaggataagatgctccgcctctggagattttccagagcctcgcctcgcctggatggaagatggagaagaactaaacgccgtcaacacgacggttgaccaggatttggacacggagctctacagcgtcagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 4 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgatttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 5 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctccgcgcaatcctcgggctga

SEQ ID NO: 6 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaatgtgacaaataaccacagcatcgtgtgtctcatcaaatacggggagctgtcggtgtcacagatcttcccttggagcaaacccaagcaggagccccccattgatcagcttccattctgggtcattatcccagtaagtggtgctttggtgctcactgcggtagttctctaccgcccggcctgcagacatgttgcgaggtggaaaagaacaagaaggaatgaagagacagtgggaactgaaaggctgtcccctatctacttaggctctgcgcaatcctcgggctga

SEQ ID NO: 7 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 8 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctgctggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 9 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacaagggcacctacacctgcgtggttcagaagcctgttttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcaggcatgttgcgaggtggaaaagaacaagaaggaatgaagagacagtgggaactgaaaggctgtcccctatctacttaggctctgcgcaatcctcgggctga

SEQ ID NO: 10 - DNA, 912 bp, Artificial Sequence; identical to SEQ ID NO: 7
  Description of Artificial Sequence: Synthetic nucleotide sequence

SEQ ID NO: 11 - DNA, 912 bp, Artificial Sequence
  Description of Artificial Sequence: Synthetic nucleotide sequence
atgggtcacacaatgaagtggagatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggatga

SEQ ID NO: 12 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctagcataactgacattggacatcccgcccctaatgtgaaaaggataagatgctccgcctctggaggttttccagagcctcgcctcgcctggatggaagatggagaagaactaaacgccgtcaacacgacggttgaccaggatttggacacggagctctacagcgtcagcagtgaactggattccaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 13 - DNA, 912 bp, Artificial Sequence; identical to SEQ ID NO: 7
  Description of Artificial Sequence: Synthetic nucleotide sequence

SEQ ID NO: 14 - DNA, 912 bp, Artificial Sequence
  Description of Artificial Sequence: Synthetic nucleotide sequence
atgggtcacacaatgaagtggcgatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaggaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 15 - DNA, 909 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacgcatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacaagggcacctacacctgcgtggttcagaagaatgagaacgggtctttcagacgggagcacctgacctccgtgacactgtccatcagagctgacttccctgtccctagcataactgacattggacatcccgcccctaatgtgaaaaggataagatgctccgcctctggaggttttccagagcctcgcctcgcctggatggaagatggagaagaactaaacgccgtcaacacgacggttgaccaggatttggacacggagctctacagcgtcagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 16 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 17 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgactagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccagagcctcgcctcgcctggatggaagatggagaagaactaaacgccgtcaacacgacggttgaccaggatttggacacggagctctacagcgtcagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 18 - DNA, 903 bp, Artificial Sequence
  Description of Artificial Sequence: Synthetic nucleotide sequence
atgggccacacgctgaggccgggaactccactgcccaggtgtctacacctcaagctctgcctgctcttggcgctggcgggtctccacttctcttcaggtatcagccaggtcaccaagtcggtgaaagaaatggcggcactgtcctgtgattacaacatttctatcgatgaactggcgagaatgcgcatatactggcagaaggaccaacagatggtgctgagcatcatctctgggcaagtggaagtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 19 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcccgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 20 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggcactgcgcctgtcggacagtggcacctacacctgtgttattcagaagcctgttttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcgctgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 21 - DNA, 909 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaaaaaccgcaccttccccgacatcattaacaacctctcccttatgatcctggcactgcgcctgtcggacaagggcacctacacctgcgtggttcagaagaatgagaacgggtctttcagacgggagcacctgacctccgtgacactgtccatcagagctgacttccctgtccctagcataactgacattggacatcccgcccctaatgtgaaaaggataagatgctccgcctccggagattttccagagcctcgcctcgcctggatggaagatggagaagaactaaacgccgtcaacacgacggttgaccaggatttggacacggagctctacagcgtcagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgtggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 22 - DNA, 867 bp, Artificial Sequence
  Description of Artificial Sequence: Synthetic nucleotide sequence
atgggccacacacggaggcagggaatatcaccatccaagtgtccatacctcaagttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagatgctttcaagcgggaacacctggctgaagtgacgttatcagtcaaagctgacttccctacacctagtatatctgactttgaaattccaccttctaacattagaaggataatttgctcaacctctggaggttttcctgagcctcacctctcctggctggaaaatggagaagaattaaatgccatcaacacaacagtttcccaagatcctggaactgagctctatactgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtatga

SEQ ID NO: 23 - DNA, 867 bp, Artificial Sequence
  Description of Artificial Sequence: Synthetic nucleotide sequence
atgggccacacacggaggcagggaatatcaccatccaagtgtccatacctcaatttctttcagctcttggtgctggcttgtctttctcatttctgttcaggtgttatccacgtgaccaaggaagtgaaagaagtggcaacgctgtcctgtggtcacaatgtttctgttgaagagctggcacaaactcgcatctactggcaaaaggggaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagatgctttcaagcgagaacacctggctgaagtgacgttatcagtcaaagctgacttccctacacctagtataactgactttgaaattccaccttctaacattagaaggataatttgctcaacctctggaggttttccagagcctcgcctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccctaatctcagtaaatggaatttttgtgatatgctgcctgacctactgctttgccccaagatgcagagagagaaggaggaatgagagattgagaagggaaagtgtacgccctgtatga

SEQ ID NO: 24 - DNA, 867 bp, Artificial Sequence
  Description of Artificial Sequence: Synthetic nucleotide sequence
atgagccacacacggaggcagggaacatcaccatccaagtgtccgtacctcaagttctttcagctcttggtgctggctagtctttctcacttctgttcaggtgttatccacatgaccaaggaagtgaaagaagtggcaacactgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagatgctttcaagcgagaacacctggctgaagtgatgttatccgtcaaagctgacttccctacacctagtataactgactttgaaattccaccttctaacattagaaggataatttgctcaacctctggaggttttccagagcctcacctcttctggctggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccctaatctcagtaaatggaatttttgtgatatgctgcctgacccactgttttgccccaagatgcagagagagaaggaggaatgagagattgagaagggaaagtgtacaccctgtatga

SEQ ID NO: 25 - DNA, 868 bp, Artificial Sequence
  Description of Artificial Sequence: Synthetic nucleotide sequence
atgggccacacacggaggcagggaatatcaccatccaagtgtccatacctcaagttctttcagctcttggtgctggcttgtctttctcatttctgttcaggtgttatccacgtgaccaaggaagtgaaagaagtggcaacactgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgggaacacctagctgaagtgacgttatcagtcaaagctgacttccctacacctagtatatctgactttgaaattccaacttctaatattagaaggataatttgctcaacctctggaggttttccagagcctcacctcttcgggttggaaaatggggaagaaataaatgccatcaacacaacagcttcccaagatcctgaaactgagctctatactgttagcagcaaactggatttcaatatgacacccaatcgcagttttgtgtgtctcatcaagtatggacatttaagagtgaatcagaccttcaactggaatacacccaagcaagagcattttcctgataacctgctcccatcctgggccattaccttaatctcagcaaatggaatttttgtgatatgctgcctgacctactgctttgccccaagatgcagagagagaaagagcaatgagagactgagaagggaaagtgtacgccctgtatgag

SEQ ID NO: 26 - DNA, 867 bp, Artificial Sequence
  Description of Artificial Sequence: Synthetic nucleotide sequence
atgagccacacacggaggcagggaatatcaccatccaagtgtccatacctcaatttctttcagctcttggtgctggctagtctttctcatttctgttcaggtgttatccacgtgaccaaggaagtgaaagaagtggcaacgctgtcctgtggtctcaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgagaacacctggctgaagtgatgttatccgtcaaagctgacttccctacacctagtatatctgactttgaaattccaccttctaacattagaaggataatttgctcaacctccggaggttttcctgagcctcacctctcctggctggaaaatggagaagaattaaatgccatcaacacaacagtttcccaagatcctgaaactgagctctatactgttagcagcaaactggatttcaatatgacagccaatcacagttttgtgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctactgctttgccccaagatgcagagagaggagaaggaatgagacactgagaagggaaagtgtacgccctgtatga

SEQ ID NO: 27 - DNA, 865 bp, Artificial Sequence
  Description of Artificial Sequence: Synthetic nucleotide sequence
atgggccacacacggaggcagggaatatcaccacccaagtgtccatacctcaatttctttcagctcttggtgctggcttgtctttctcatttctgttcaggtgttatccacgtgactaaggaagtgaaagaagtggcaacactgtcctgtggtcacaatgtttctgttgaagagctggcacaaactcgcatccactggcaaaaggagaagaaaatggtgctgactatgatgtccggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgggaacacctggctgaagtgatgttatccgtcaaagctgacttccctacacctagtataactgactttgaaattccaccttctaacattagaaggataatttgctcaacctctggaggttttcctgagcctcacctctcctggctggaaaatggagaagaattaaatgccatcaacacaacagtttcccaagatcctgaaactgagctctatactgttagcagcaaactggatttcaatatgacagccaatcacagttttgtgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctactgctttgccccaagatgcagagagagaaggaatgagacactgagaagggaaagtgtacgccctgtatgac

SEQ ID NO: 28 - DNA, 869 bp, Artificial Sequence
  Description of Artificial Sequence: Synthetic nucleotide sequence
atgagccacacacggaggcagggaatatcaccatccaagtgtccatacctcaagttctttcagctcttggtgctggcttgtctttctcatttctgttcaggtgttatccacgtgaccaaggaagtgaaagaagtggcaacactgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgagaacacctggctgaagtgatgttatccgtcaaagctgacttccctacacctagtataactgactttgaaattccaccttctaacattagaaggataatttgctcaacctctggaggttttccagagcctcacctcttctggctggaaaatggggaagaattaaatgccatcaacacaacagtttcccaagatcctgaaactgagctctatactgttagcagcaaactggatttcaatatgacaaccgatcgcagttttgtgtgtctcatcaagtatggacatttaagagtgaatcagaccttcaactggaatacacccaagcaagagcattttcctgataacctgctcccatcctgggccattaccttaatctcagcaaatggaatttttgtgatatgctgcctgacctactgctttgccccaagatgcagagagagaaagagcaatgagacactgagaagggaaagtgtacgccctgtatgaaa

SEQ ID NO: 29 - DNA, 867 bp, Artificial Sequence
  Description of Artificial Sequence: Synthetic nucleotide sequence
atgagccacacacggaggcagggaatatcaccatccaagtgtccgtacctcaagttctttcagctcttggtgctggctagtctttctcatttctgttcaggtgttatccacgtgaccaaggaagtgaaagaagtggcaacgctgtcctgtggtcacaatgtttctgttgaagagctggcacaaactcgcatccactggcaaaaggagaagaaaatggtgctgaccatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgagaacacctagctgaagtgacgttatcagtcaaagctgacttccctacacctagtataactgactttgaaattccaccttctaacattaaaaggataatttgctcaacctccggaggttttcctgagcctcacctctcctggctggaaaatggggaagaattaaatgccatcaacacaacagtttcccaagatcctgaaactgagctctatactgttagcagcaaactggatttcaatatgacaaccaaccacagcttcatgtgtctcatcaagtatggacatttaagagtgaatcagaccttcaactggaatacacccaagcaagagcattttcctgataacccactcccatcctgggccattaccttaatctcagcaaatggaatttttgtgatatgctgcctgacctactgctttgccccaagatgcagagagaggagaaggaatgagacactgagaagggaaagtgtacgccctgtatga

SEQ ID NO: 30 - DNA, 868 bp, Artificial Sequence
  Description of Artificial Sequence: Synthetic nucleotide sequence
atgggccacacacggaggcagggaacatcaccatccaagtgtccgtacctcaagttctttcagctcttggtgctggcttgtctttctcatttctgttcaggtgttatccacgtgaccaaggaagtgaaagaagtggcaacactgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgggaacacctggctgaagtgatgttatccgtcaaagctgacttccctacacctagtataactgactttgaaattccaacttctaacattagaaggataatttgctcaacctccggaggttttcctgagcctcacctctcctggctggaaaatggagaagaattaaatgccatcaacacaacagtttcccaagatcctgaaactgagctctatactgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctaccgctttgccccaagatgcagagagagaaagagcaatgagagactgagaagggaaagtgtacgccctgtatgac

SEQ ID NO: 31 - DNA, 868 bp, Artificial Sequence
  Description of Artificial Sequence: Synthetic nucleotide sequence
atgggctacacacggaggcagggaacatcaccatccaagtgtccgtacctcaagttctttcagctcttggtgctggcttgtctttctcatttctgttcaggtgttatccacgtgaccagggaagtgaaagaagtggcaacactgtcctgtggccacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgggaacacctagctgaagtgatgttatccgtcaaagctgacttccctacacctagtatatctgactttgaaattccaacttctaatattagaaggataatttgctcaacctctggaggttttcctgagcctcacctctcctggctggaaaatggagaagaattaaatgccatcaacacaacagtttcccaagatcctgaaactgggctctatactgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtatgccctgtataag

SEQ ID NO: 32 - DNA, 868 bp, Artificial Sequence
  Description of Artificial Sequence: Synthetic nucleotide sequence
atgagccacacacggaggcagggaacatcaccatccaagtgtccgtacctcaagttctttcagctcttggtgctggctagtctttctcatttctgttcaggtgttatccacgtgaccaaggaagtgaaagaagtggcaacactgtcctgtggtctcaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctggagtatgaaaaagacgctttcaagcgggaacacctggctgaagtgatgttatccgtcaaagctgacttccctacacctagtatatctgactttgaaattccaccttctaacattagaaggataatttgctcaacctctggaggttttcctgagcctcacctctcctggctggaaaatggggaagaattaaatggcatcaacacaacagtttcccaagatcctgaaactgagctctatactgttagcagcaaactggatttcaatatgacaaccaatcgcagttttgtgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctactgctttgccccaagatgcagagagaggaggaggaatgagagactgagaagggaaagtgtacaccctgtatgag

SEQ ID NO: 33 - DNA, 867 bp, Artificial Sequence
  Description of Artificial Sequence: Synthetic nucleotide sequence
atgagccacacacggaggcagggaatatcaccatccaagtgtccatacctcaatttctttcggctcttggtgctggctagtctttctcatttctgttcaggtgttatccacgtgaccaaggaagtgaaagaagtggcaacactgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgagaacacctagctgaagtgacgttatcagtcaaagctggcttccctacacctagtataactgactttgaaattccaccttctaacattagaaggataatttgctcaacctctggaggttttccagagcctcacctctcctggctggaaaatggagaagaattaaatgccatcaacacaacagtttcccaagatcctggaactgagctctatactgttagcagcaaactggatttcaatatgacagccaatcacagttttgtgtgtctcatcaagtatggacatttaagagtgaatcagaccttcaactggaatacacccaagcaagagcattttcctgataacctgctcccatcctgggccattaccttaatctcagcaaatggaatttttgtgatatgctgcctgacctactgctttgccccaagatgcagagagagaaggaggaatgagagattgagaagggaaagtgtacgccctgtatga

SEQ ID NO: 34 - DNA, 868 bp, Artificial Sequence
  Description of Artificial Sequence: Synthetic nucleotide sequence
atgagccacacacggaggcagggaacatcaccatccaagtgtccatacctcaagttctttcagctcttggtgctggctagtctttctcacttctgttcaggtgttatccacatgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcaggaacacctggctgaagtgatgttatccgtcaaagctgacttccctacacctagtataactgactttgaaattccaccttctaacattagaaggataatttgctcaacctctggaggttttccagagcctcacctcttctggctggaaaatggagaggaattaaatgccatcaacacaacagtttcccaagaccctgaaactgagctctatgctgttagcagcaaactggatttcaatatgacaaccaaccacagttttgtgtgtctcatcaagtatggacatttaagagtgaatcagaccttcaactggaatacacccaagcaagagcattttcctgataacctgctcccatcctgggccattaccttaatctcagcaaatggaatttttgtgatatgctgcctgacctactgctttgccccaagatgcagagagagaaggaggaatgagagattgagaagggaaagtgtacaccctgtatgat

SEQ ID NO: 35 - DNA, 868 bp, Artificial Sequence
  Description of Artificial Sequence: Synthetic nucleotide sequence
atgggctacacacggaggcagggaatatcaccatccaagtgtccatacctcaagttctttcagctcttggtgctggcttgtctttctcatttctgttcaggtgttatccacgtgaccaaggaagtgaaagaagtggcaacactgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctggagtatgaaaaagacgctttcaagcgggaacacctggctgaagtgacgttatcagtcaaagctgacttccctacacctagtatatctgactttgaaattccaccttctaacattagaaggataatttgctcaacctctggaggttttccagagcctcacctcttctggctggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccttaatctcagcaaatggaatttttgtgatatgctgcctgacctactgctttgccccaagatgcagagagagaaagagcaatgagagactgagaagggaaagtgtacaccctgtatgat

SEQ ID NO: 36 - DNA, 868 bp, Artificial Sequence
  Description of Artificial Sequence: Synthetic nucleotide sequence
atgagccacacacggaggcagggaatatcaccatccaagtgtccatacctcaagttctttcagctcttggtgctggcttgtctttctcatttctgttcaggtgttatccacgtgaccaaggaagtgaaagaagtggcaacgctgtcctgtggtcacaatgtttctgttgaagagctagcacaaactcgcatctactggcaaaaggagaagaaaatggtgctgactatgatgtctggggacatgaatatatggcccgagtacaagaaccggaccatctttgatatcactaataacctctccattgtgattctggctctgcgctcatctgacgagggcacatacgagtgtgttgttctgaagtatgaaaaagacgctttcaagcgggaacacctagctgaagtgacgttatcagtcaaagctgacttccctacacctagtataactgactttgaaattccaccttctaacattagaaggataatttgctcaacctctggaggttttcctgagcctcacctctcctggctggaaaatggagaagaattaaatgccatcagcacaacagtttcccaagatcctgaaactgagctctacactgttagcagcaaactggatttcaatatgacaaccaatcgcagttttgtgtgtctcatcaagtatggacatttaagagtgaatcagaccttcaactggaatacacccaagcaagagcattttcctgataacctgctcccatcctgggccattaccctaatctcagtaaatggaatttttgtgatatgctgcctgacctactgctttgccccaagatgcagagagagaaggagcaatgagagactgagaagggaaagtgtacgccctgtatgaa

SEQ ID NO: 37 - DNA, 868 bp, Artificial Sequence
  Description of Artificial Sequence: Synthetic nucleotide sequence
atgggccacacacggaggcagggaatatcaccatccaagtgtccgtacctcaatttctttcagctcttggtgctagctggtctttctcacttctgttcaggtgttatccacgtgaccaaggaagtgaaagaagtggcaacactgtcctgtggtcacaatgtttctgttgaagagctggcacaaactcgcatctactggcaaaaggggaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctggagtatgaaaaagacgctttcaagcgagaacacctggctgaagtgatgttatccgtcaaagctgacttccctacacctagtatatctgactttgaaattccaacttctaatattagaaggataatttgctcaacctctggaggttttcctgagcctcacctctcctggctggaaaatggagaagaattaaatgccatcaacacaacagcttcccaagatcctgaaactgagctctatactgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccttaatctcagcaaatggaatttttgtgatatgctgcctggcctactgctttgccccaggatgcagagagagaaagagcaatgagagactgagaagggaaagtgtacgccctgtatgac

SEQ ID NO: 38 - DNA, 867 bp, Artificial Sequence
  Description of Artificial Sequence: Synthetic nucleotide sequence
atgggccacacacggaggcagggaatatcaccatccaagtgtccatacctcaagttctttcagctcttggtgctggcttgtctttctcatctctgttcaggtgttatccacgtgaccaaggaagtgaaagaagtggcaacactgtcctgtggtctcaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgataaagacgctttcaagcgggaacacctggctgaagtgacgttgtcagtcaaagctgacttccctacacctagtatatctgactttgaaattccaccttctaacattagaaggataatttgctcaacctccggaggttttcctgagcctcacctctcctggctggaaaatggagaagaattaaatgccatcaacacaacagtttcccaagatcctgaaactgagctctatactgttagcagcaaactggatttcaatatgacagccaatcacagttttgtgtgtctcatcaagtatggacatttaagagtgaatcagaccttcaactggaatacacccaagcaagagcattttcctgataacctgctcccatcctgggccattaccctaatctcagtaaatggaatttttgtgatatgctgcctgacctaccgctttgccccaagatgcagagagagaaagagcaatgagagactgagaagggaaagtgtacgccctgtatga

SEQ ID NO: 39 - DNA, 867 bp, Artificial Sequence
  Description of Artificial Sequence: Synthetic nucleotide sequence
atgggccacacacggaggcagggaacatcaccatccaagtgtccatacctcaagttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccatcgtgattctggctctgcgcccatctgacgagggcacatacgagtgtgttgttctgaagtatgaaaaagatgctttcaagcgagaacacctggctgaagtgatgttatccgtcaaagctgacttccctacacctagtatatctgactttgaaattccaccttctaacattagaaggataatttgctcaacctctggaggttttccagagcctcacctcttctggttggaaaatggggaagaattaaatgccatcaacacaacagtttcccaagatcctgaaactgagctctatactgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccttaatctcagcaaatggaatttttgtgatatgctgcctgacctaccgctttgccccaagatgcagagagagaaagagcaatgagacactgagaagggaaagtgtacgccctgtatga

SEQ ID NO: 40 - DNA, 868 bp, Artificial Sequence
  Description of Artificial Sequence: Synthetic nucleotide sequence
atgggccacacacggaggcagggaacatcaccatccaagtgtccgtacctcaagttctttcagctcttggtgatggcttgtctttctcatttctgttcaggtgttatccacgtgaccaaggaagtgaaagaagtggcaacactgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgagaacacctagctgaagtgatgttatccgtcaaagctgacttccctacacctagtatatctgactttgaaattccaacttctaatattagaaggataatttgctcaacctctggaggttttccagagcctcacctcttctggttggaaaatggggaagaattaaatgccatcaacacaacagtttcccaagatcctgaaactgagctctatactgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccctaatctcagtaaatggaatttttgtgatatgctgcctgacctactgctttgccccaagatgcagagagagaaggaggaatgagagattgagaagggaaagtgtatgccctgtatgag

SEQ ID NO: 41 - DNA, 868 bp, Artificial Sequence
  Description of Artificial Sequence: Synthetic nucleotide sequence
atgggccacacacggaggcagggaatatcaccatccaagtgtccatacctcaagttctttcagctcttggtgctagcttgtctttctcatttctgttcaggtgttatccacgtgaccaaggaagtgaaagaagtggcaacgctgtcctgtggtctcaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgagaacacctggctgaagtgatgttatccgtcaaagctgacttccctacacctagtatatctgactttgaaattccaccttctaacattagaaggataatttgctcaacctctggaggttttcctgagcctcacctctcctggctggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctactgctttgccccaagatgcagagagaggagaaggaatgagacactgagaagggaaagtgtacgccctgtatgac

SEQ ID NO: 42 - DNA, 868 bp, Artificial Sequence
  Description of Artificial Sequence: Synthetic nucleotide sequence
atgggccacacacggaggcagggaatatcaccatccaagtgtccatacctcaagttctttcagctcttggtgctggctggtcttcctcatctctgttcaggtgttatccacgtgaccaaggaagtgaaagaagtggcaacactgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagatgctttcaagcgggaacacctggctgaagtgatgttatccgtcaaagctgacttccctacacctagtataactgactttgaaattccaccttctaacattagaaggataatttgctcaacctctggaggttttcctgagccccacctctcctggctggaaaatggagaagaattaaatgccatcagcacaacagtttcccaagatcctgaaactgagctctatactgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagcaaatggaatttttgtgatatgctgcctgacccactgttttgccccaagatgcagagagagaaagaggaatgagagactgagaagggaaagtgtacgccctgtatgac

SEQ ID NO: 43 - DNA, 868 bp, Artificial Sequence
  Description of Artificial Sequence: Synthetic nucleotide sequence
atgagccacacacggaggcagggaacatcaccatccaagtgtccatacctcaagttctttcagctcctggtgctggctggtctttctcatctctgttcaggtgttatccacgtgaccaaggaagtgaaagaagtggcaacgctgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgagaacacctggctgaagtgatgttatccgtcaaagctgacttccctacacctagtatatctgactttgaaattccaacttctaacattagaaggataatttgctcaacctctggaggttttccagagcctcacctctcctggctggaaaatggagaagaattaaatgccatcaacacaacagtttcccaagatcctgaaactgagctctatactgttagcagcaaactggatttcaatatgacagccaatcacagttttgtgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtatgat

SEQ ID NO: 44 - DNA, 867 bp, Artificial Sequence
  Description of Artificial Sequence: Synthetic nucleotide sequence
atgggccacacacggaggcagggaatatcaccatccaagtgtccgtacctcaatttctttcagctcttggtgctggcttgtctttctcatttctgttcaggtgttatccacgtgaccaaggaagtgaaagaagtggcaacactgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgggaacacctggctgaagtgatgttatcagtcaaagctgacttccctacacctagtataactgactttgaaattccaccttctaacattagaaggataatttgctcagcctctggaggttttccagagcctcacctcttctggctggaaaatggagaagaattaaatgccatcaacacaacagtttcccaagatcctgaaactgagctctatgctgttagcagcaaactggatttcaatatgacaaccaaccacagcttcatgtgtctcatcaggtatggacatttaagagtgaatcagaccttcaactggaatacacccaagcaagagcattttcctgataacctgctcccatcctgggccattaccctaatctcagtaaatggaatttttgtgatatgctgcctgacctactgctttgccccaagatgcagagagagaaagagcaatgagagactgagaagggaaagtgtacgccctgtatga

SEQ ID NO: 45 - DNA, 868 bp, Artificial Sequence
  Description of Artificial Sequence: Synthetic nucleotide sequence
atgggccacacacggaggcagggaacatcaccatccaagtgtccgtacctcaatttctttcagctcttggtgctggcttgtctttctcatttctgttcaggtgttatccacgtgaccaaggaagtgaaagaagtggcaacgctgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgagaacacctggctgaagtgatgttatccgtcaaagctgacttccctacacctagtataactgactttgaaattccaccttctaacattagaaggataatttgctcaacctccggaggttttccagagcctcacctctcctggctggaaaatggagaagaattaaatgccatcaacacaacagcttcccaagatcctgaaactgagctctatactgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctactgctttgccccaagatgcagagagagaaagagcaatgagagactgagaagggaaagtgtacgccctgtatgag

SEQ ID NO: 46 - DNA, 867 bp, Papio sp.
atgggccacacacggaggcagggaatatcaccatccaagtgtccatacctcaagttctttcagctcttggtgctggcttgtctttctcatttctgttcaggtgttatccacgtgaccaaggaagtgaaagaagtggcaacactgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagatgctttcaagcgagaacacctggctgaagtgatgttatccgtcaaagctgacttccctacacctagtataactgactttgaaattccaccttctaacattagaaggataatttgctcaacctctggaggttttccagagcctcacctcttctggttggaaaatggagaagaattaaatgccatcaacacaacagtttcccaagatcctggaactgagctctatactgttagcagcaaactggatttcaatatgacaaccaatcacagttttgtgtgtctcatcaagtatggacatttaagagtgaatcagaccttcaactggaatacacccaagcaagagcattttcctgataacctgctcccatcctgggccattaccctaatctcagtaaatggaatttttgtgatatgctgcctgacctactgttttgccccaagatgcagagagagaagaaggaatgagacattgagaagggaaagtgtacgccctgtatga

SEQ ID NO: 47 - DNA, 867 bp, Pongo pygmaeus
atgggccacacacggaggcagggaacatcaccatccaagtgtccatacctcaatttctttcagctcttggtgctggctagtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatatgagtgtgttgttctgaagtatgaaaaagacgctttcaagcgggaacacctggctgaagtgacgttatcggtcaaagctgacttccctacacctagtatatctgactttgaaattccaacttctaatattagaaggatgatttgctcaacctctggaggttttccagagcctcacctctcctggttggaaaatggagaagaattaaatgccatcagcacaacagtttcccaagatcctgaaactgagctctatgctgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctactgctttgccccaagatgcagagagagaaggagcaatgagagactgagaagggaaagtgtacgccctgtatga

SEQ ID NO: 48 - protein, 296 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPRPHLYWLENGEELNATNTTLSQDPETKLYMISSELDFNMTSNHSFLCLVKYGDLTVSQTFYWQESKPTPSANQHLTWTIIIPVSAFGISVIIAVILTCLTCRNAAIRRQRRENEVEMQSCSQSP

SEQ ID NO: 49 - protein, 299 aa, Artificial Sequence
  Description of Artificial Sequence: Synthetic peptide
MGHTLRPGTPLPRCLHLKLCLLLALAGLHFSSGISQVTKSVKEMAALSCDYNISIDELARMRIYWQKDQQMVLSIISGQVEVWPEYKNRTFPDIINNLSLMILALRLSDKGTYTCVVQKNENGSFRREHLTSVTLSIRADSPVPSITDIGHPAPNVKRIRCSASGGFPEPRLAWMEDGEELNAVNTTVDQDLDTELYSVSSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 50 - protein, 299 aa, Artificial Sequence
  Description of Artificial Sequence: Synthetic peptide
MGHTLRPGTPLPRCLHLKLCLLLALAGLHFSSGISQVTKSVKEMAALSCDYNISIDELARMRIYWQKDQQMVLSIISGQVEVWPEYKNRTFPDIINNLSLMILALRLSDKGTYTCVVQKNENGSFRREHLTSVTLSIRADFPVPSITDIGHPAPNVKRIRCSASGDFPEPRLAWMEDGEELNAVNTTVDQDLDTELYSVSSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 51 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDSGTYTCVIQKPDLKGAYKLEHLTSVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 52 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 53 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPRPHLYWLENGEELNATNTTLSQDPETKLYMISSELDFNVTNNHSIVCLIKYGELSVSQIFPWSKPKQEPPIDQLPFWVIIPVSGALVLTAVVLYRPACRHVARWKRTRRNEETVGTERLSPIYLGSAQSSG

SEQ ID NO: 54 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 55 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPRPHLCWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 56 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDKGTYTCVVQKPVLKGAYKLEHLTSVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 57 - protein, 303 aa, Artificial Sequence; identical to SEQ ID NO: 54
  Description of Artificial Sequence: Synthetic peptide

SEQ ID NO: 58 - protein, 303 aa, Artificial Sequence
  Description of Artificial Sequence: Synthetic peptide
MGHTMKWRSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 59 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLASVRLMIRADFPVPSITDIGHPAPNVKRIRCSASGGFPEPRLAWMEDGEELNAVNTTVDQDLDTELYSVSSELDSNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 60 - protein, 303 aa, Artificial Sequence; identical to SEQ ID NO: 54
  Description of Artificial Sequence: Synthetic peptide

SEQ ID NO: 61 - protein, 303 aa, Artificial Sequence
  Description of Artificial Sequence: Synthetic peptide
MGHTMKWRSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDSGTYTCVIQKPVLKGAYKLEHLTSVRLMIRADFPVPTINDLGNPSPNIRRLICSTSGGFPRPHLYWLENGEELNATNTTLSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 62 - protein, 302 aa, Artificial Sequence
  Description of Artificial Sequence: Synthetic peptide
MGHTMKWGSLPPKRPCLWLSQLLVLTGLFYFCSGITPKSVTKRVKETVMLSCDYNASTEELTSLRIYWQKDSKMVLAILPGKVQVWPEYKNRTITDMNDNPRIVILALRLSDKGTYTCVVQKNENGSFRREHLTSVTLSIRADFPVPSITDIGHPAPNVKRIRCSASGGFPEPRLAWMEDGEELNAVNTTVDQDLDTELYSVSSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 63 - protein, 303 aa, Artificial Sequence; identical to SEQ ID NO: 52
  Description of Artificial Sequence: Synthetic peptide

SEQ ID NO: 64 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPEPRLAWMEDGEELNAVNTTVDQDLDTELYSVSSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 65 - protein, 300 aa, Artificial Sequence
  Description of Artificial Sequence: Synthetic peptide
MGHTLRPGTPLPRCLHLKLCLLLALAGLHFSSGISQVTKSVKEMAALSCDYNISIDELARMRIYWQKDQQMVLSIISGQVEVWPEYKNRTITDMNDNPRIVILALRLSDSGTYTCVIQKPVLKGAYKLEHLASVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 66 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRPSDSGTYTCVIQKPVLKGAYKLEHLASVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 67 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLTSVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLAAVVLYCLACRHVARWKRTRRNEETVGTERLSPIYLGSAQSSG

SEQ ID NO: 68 - protein, 302 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTFPDIINNLSLMILALRLSDKGTYTCVVQKNENGSFRREHLTSVTLSIRADFPVPSITDIGHPAPNVKRIRCSASGDFPEPRLAWMEDGEELNAVNTTVDQDLDTELYSVSSELDFNVTNNHSIVCLIKYGELSVSQIFPWSKPKQEPPIDQLPFWVIIPVSGALVLTVVVLYCLACRHVARWKRTRRNEETVGTERLSPIYLGSAQSSG

SEQ ID NO: 69 - protein, 288 aa, Artificial Sequence
  Description of Artificial Sequence: Synthetic peptide
MGHTRRQGISPSKCPYLKFFQLLVLAGLSHFCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVTLSVKADFPTPSISDFEIPPSNIRRIICSTSGGFPEPHLSWLENGEELNAINTTVSQDPGTELYTVSSKLDFNMTTNHSFMCLIKYGHLRVNQTFNWNTPKQEHFPDNLLPSWAITLISVNGIFVICCLTYCFAPRCRERRRNERLRRESVRPV

SEQ ID NO: 70 - protein, 288 aa, Artificial Sequence
  Description of Artificial Sequence: Synthetic peptide
MGYTRRQGTSPSKCPYLKFFQLLVLAGLSHLCSGVIHVTNEVKEVATLSCGHNVSGEELAQTRIYWQKEKKMVLTMMYGDMNIWPEYKNRTIFDITNNLSIVILALRPSDEGTYECVVLKYEKDAFKREHLAEVMLSVKADFPTPSITDFEIPPSNIRRIICLTSGGFPEPRLAWMKDGEELNAISTTVSQDPGTELYAVSSKLDFNMTTNHSFMCLIKYGHLRVNQTFSWNTPKQEHFPDNLLPSWAITLISVNGIFVICCLTYCFAPRCRERRRNERLRRESVRPV

SEQ ID NO: 71 - protein, 288 aa, Artificial Sequence
  Description of Artificial Sequence: Synthetic peptide
MSHTRRQGTSPSKCPYLKFFQLLVLASLSHFCSGVIHMTKEVKEVATLSCGHNVSVEELAQTRIYWQKEKKMVLTMMSGDMNIWPEYKNRTIFDITNNLSIVILALRPSDEGTYECVVLKYEKDAFKREHLAEVMLSVKADFPTPSITDFEIPPSNIRRIICSTSGGFPEPHLFWLENGEELNAINTTVSQDPETELYAVSSKLDFNMTTNHSFMCLIKYGHLRVNQTFNWNTTKQEHFPDNLLPSWAITLISVNGIFVICCLTHCFAPRCRERRRNERLRRESVHPV

SEQ ID NO: 72 - protein, 288 aa, Artificial Sequence
  Description of Artificial Sequence: Synthetic peptide
MGHTRRQGISPSKCPYLKFFQLLVLACLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLFGLENGEEINAINTTASQDPETELYTVSSKLDFNMTPNRSFVCLIKYGHLRVNQTFNWNTPKQEHFPDNLLPSWAITLISANGIFVICCLTYCFAPRCRERKSNERLRRESVRPV

SEQ ID NO: 73 - protein, 288 aa, Artificial Sequence
  Description of Artificial Sequence: Synthetic peptide
MSHTRRQGISPSKCPYLNFFQLLVLASLSHFCSGVIHVTKEVKEVATLSCGLNVSVEELAQTRIYWQKEKKMVLTMMSGDMNIWPEYKNRTIFDITNNLSIVILALRPSDEGTYECVVLKYEKDAFKREHLAEVMLSVKADFPTPSISDFEIPPSNIRRIICSTSGGFPEPHLSWLENGEELNAINTTVSQDPETELYTVSSKLDFNMTANHSFVCLIKYGHLRVNQTFNWNTPKQEHFPDNLLPSWAITLISVNGIFVICCLTYCFAPRCRERRRNETLRRESVRPV

SEQ ID NO: 74 - protein, 287 aa, Artificial Sequence
  Description of Artificial Sequence: Synthetic peptide
MGHTRRQGISPPKCPYLNFFQLLVLACLSHFCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVMLSVKADFPTPSITDFEIPPSNIRRIICSTSGGFPEPHLSWLENGEELNAINTTVSQDPETELYTVSSKLDFNMTANHSFVCLIKYGHLRVNQTFNWNTPKQEHFPDNLLPSWAITLISVNGIFVICCLTYCFAPRCRERRNETLRRESVRPV

SEQ ID NO: 75 - protein, 288 aa, Artificial Sequence
  Description of Artificial Sequence: Synthetic peptide
MSHTRRQGISPSKCPYLKFFQLLVLACLSHFCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVMLSVKADFPTPSITDFEIPPSNIRRIICSTSGGFPEPHLFWLENGEELNAINTTVSQDPETELYTVSSKLDFNMTTDRSFVCLIKYGHLRVNQTFNWNTPKQEHFPDNLLPSWAITLISANGIFVICCLTYCFAPRCRERKSNETLRRESVRPV

SEQ ID NO: 76 - protein, 288 aa, Artificial Sequence
  Description of Artificial Sequence: Synthetic peptide
MSHTRRQGISPSKCPYLKFFQLLVLASLSHFCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVTLSVKADFPTPSITDFEIPPSNIKRIICSTSGGFPEPHLSWLENGEELNAINTTVSQDPETELYTVSSKLDFNMTTNHSFMCLIKYGHLRVNQTFNWNTPKQEHFPDNPLPSWAITLISANGIFVICCLTYCFAPRCRERRRNETLRRESVRPV

SEQ ID NO: 77 - protein, 288 aa, Artificial Sequence
  Description of Artificial Sequence: Synthetic peptide
MGHTRRQGTSPSKCPYLKFFQLLVLACLSHFCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVMLSVKADFPTPSITDFEIPTSNIRRIICSTSGGFPEPHLSWLENGEELNAINTTVSQDPETELYTVSSKLDFNMTTNHSFMCLIKYGHLRVNQTFNWNTPKQEHFPDNLLPSWAITLISVNGIFVICCLTYRFAPRCRERKSNERLRRESVRPV

SEQ ID NO: 78 - protein, 288 aa, Artificial Sequence
  Description of Artificial Sequence: Synthetic peptide
MGYTRRQGTSPSKCPYLKFFQLLVLACLSHFCSGVIHVTREVKEVATLSCGHNVSVEELAQTRIHWQKEKKMVLTMMSGDMNIWPEYKNRTIFDITNNLSIVILALRPSDEGTYECVVLKYEKDAFKREHLAEVMLSVKADFPTPSISDFEIPTSNIRRIICSTSGGFPEPHLSWLENGEELNAINTTVSQDPETGLYTVSSKLDFNMTTNHSFMCLIKYGHLRVNQTFNWNTPKQEHFPDNLLPSWAITLISVNGIFVICCLTYCFAPRCRERRRNERLRRESVCPV

SEQ ID NO: 79 - protein, 288 aa, Artificial Sequence
  Description of Artificial Sequence: Synthetic peptide
MSHTRRQGTSPSKCPYLKFFQLLVLASLSHFCSGVIHVTKEVKEVATLSCGLNVSVEELAQTRIYWQKEKKMVLTMMSGDMNIWPEYKNRTIFDITNNLSIVILALRPSDEGTYECVVLEYEKDAFKREHLAEVMLSVKADFPTPSISDFEIPPSNIRRIICSTSGGFPEPHLSWLENGEELNGINTTVSQDPETELYTVSSKLDFNMTTNRSFVCLIKYGHLRVNQTFNWNTPKQEHFPDNLLPSWAITLISVNGIFVICCLTYCFAPRCRERRRNERLRRESVHPV

SEQ ID NO: 80 - protein, 288 aa, Artificial Sequence
  Description of Artificial Sequence: Synthetic peptide
MSHTRRQGISPSKCPYLNFFRLLVLASLSHFCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVTLSVKAGFPTPSITDFEIPPSNIRRIICSTSGGFPEPHLSWLENGEELNAINTTVSQDPGTELYTVSSKLDFNMTANHSFVCLIKYGHLRVNQTFNWNTPKQEHFPDNLLPSWAITLISANGIFVICCLTYCFAPRCRERRRNERLRRESVRPV

SEQ ID NO: 81 - protein, 288 aa, Artificial Sequence
  Description of Artificial Sequence: Synthetic peptide
MSHTRRQGTSPSKCPYLKFFQLLVLASLSHFCSGVIHMTKEVKEVATLSCGHNVSVEELAQTRIYWQKEKKMVLTMMSGDMNIWPEYKNRTIFDITNNLSIVILALRPSDEGTYECVVLKYEKDAFKQEHLAEVMLSVKADFPTPSITDFEIPPSNIRRIICSTSGGFPEPHLFWLENGEELNAINTTVSQDPETELYAVSSKLDFNMTTNHSFVCLIKYGHLRVNQTFNWNTPKQEHFPDNLLPSWAITLISANGIFVICCLTYCFAPRCRERRRNERLRRESVHPV

SEQ ID NO: 82 - protein, 288 aa, Artificial Sequence
  Description of Artificial Sequence: Synthetic peptide
MGYTRRQGISPSKCPYLKFFQLLVLACLSHFCSGVIHVTKEVKEVATLSCGHNVSVEELAQTRIYWQKEKKMVLTMMSGDMNIWPEYKNRTIFDITNNLSIVILALRPSDEGTYECVVLEYEKDAFKREHLAEVTLSVKADFPTPSISDFEIPPSNIRRIICSTSGGFPEPHLFWLENGEELNAINTTVSQDPETELYAVSSKLDFNMTTNHSFMCLIKYGHLRVNQTFNWNTPKQEHFPDNLLPSWAITLISANGIFVICCLTYCFAPRCRERKSNERLRRESVHPV

SEQ ID NO: 83 - protein, 288 aa, Artificial Sequence
  Description of Artificial Sequence: Synthetic peptide
MSHTRRQGISPSKCPYLKFFQLLVLACLSHFCSGVIHVTKEVKEVATLSCGHNVSVEELAQTRIYWQKEKKMVLTMMSGDMNIWPEYKNRTIFDITNNLSIVILALRSSDEGTYECVVLKYEKDAFKREHLAEVTLSVKADFPTPSITDFEIPPSNIRRIICSTSGGFPEPHLSWLENGEELNAISTTVSQDPETELYTVSSKLDFNMTTNRSFVCLIKYGHLRVNQTFNWNTPKQEHFPDNLLPSWAITLISVNGIFVICCLTYCFAPRCRERRSNERLRRESVRPV

SEQ ID NO: 84 - protein, 288 aa, Artificial Sequence
  Description of Artificial Sequence: Synthetic peptide
MGHTRRQGISPSKCPYLNFFQLLVLAGLSHFCSGVIHVTKEVKEVATLSCGHNVSVEELAQTRIYWQKGKKMVLTMMSGDMNIWPEYKNRTIFDITNNLSIVILALRPSDEGTYECVVLEYEKDAFKREHLAEVMLSVKADFPTPSISDFEIPTSNIRRIICSTSGGFPEPHLSWLENGEELNAINTTASQDPETELYTVSSKLDFNMTTNHSFMCLIKYGHLRVNQTFNWNTPKQEHFPDNLLPSWAITLISANGIFVICCLAYCFAPGCRERKSNERLRRESVRPV

SEQ ID NO: 85 - protein, 288 aa, Artificial Sequence
  Description of Artificial Sequence: Synthetic peptide
MGHTRRQGISPSKCPYLKFFQLLVLACLSHLCSGVIHVTKEVKEVATLSCGLNVSVEELAQTRIHWQKEKKMVLTMMSGDMNIWPEYKNRTIFDITNNLSIVILALRPSDEGTYECVVLKYDKDAFKREHLAEVTLSVKADFPTPSISDFEIPPSNIRRIICSTSGGFPEPHLSWLENGEELNAINTTVSQDPETELYTVSSKLDFNMTANHSFVCLIKYGHLRVNQTFNWNTPKQEHFPDNLLPSWAITLISVNGIFVICCLTYRFAPRCRERKSNERLRRESVRPV

SEQ ID NO: 86 - protein, 288 aa, Artificial Sequence
  Description of Artificial Sequence: Synthetic peptide
MGHTRRQGTSPSKCPYLKFFQLLVLAGLSHFCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVMLSVKADFPTPSISDFEIPPSNIRRIICSTSGGFPEPHLFWLENGEELNAINTTVSQDPETELYTVSSKLDFNMTTNHSFMCLIKYGHLRVNQTFNWNTPKQEHFPDNLLPSWAITLISANGIFVICCLTYRFAPRCRERKSNETLRRESVRPV

SEQ ID NO: 87 - protein, 288 aa, Artificial Sequence
  Description of Artificial Sequence: Synthetic peptide
MGHTRRQGTSPSKCPYLKFFQLLVMACLSHFCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVMLSVKADFPTPSISDFEIPTSNIRRIICSTSGGFPEPHLFWLENGEELNAINTTVSQDPETELYTVSSKLDFNMTTNHSFMCLIKYGHLRVNQTFNWNTPKQEHFPDNLLPSWAITLISVNGIFVICCLTYCFAPRCRERRRNERLRRESVCPV

SEQ ID NO: 88 - protein, 288 aa, Artificial Sequence
  Description of Artificial Sequence: Synthetic peptide
MGHTRRQGISPSKCPYLKFFQLLVLACLSHFCSGVIHVTKEVKEVATLSCGLNVSVEELAQTRIHWQKEKKMVLTMMSGDMNIWPEYKNRTIFDITNNLSIVILALRPSDEGTYECVVLKYEKDAFKREHLAEVMLSVKADFPTPSISDFEIPPSNIRRIICSTSGGFPEPHLSWLENGEELNAINTTVSQDPETELYAVSSKLDFNMTTNHSFMCLIKYGHLRVNQTFNWNTPKQEHFPDNLLPSWAITLISVNGIFVICCLTYCFAPRCRERRRNETLRRESVRPV

SEQ ID NO: 89 - protein, 288 aa, Artificial Sequence
  Description of Artificial Sequence: Synthetic peptide
MGHTRRQGISPSKCPYLKFFQLLVLAGLPHLCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVMLSVKADFPTPSITDFEIPPSNIRRIICSTSGGFPEPHLSWLENGEELNAISTTVSQDPETELYTVSSKLDFNMTTNHSFMCLIKYGHLRVNQTFNWNTTKQEHFPDNLLPSWAITLISANGIFVICCLTHCFAPRCRERKRNERLRRESVRPV

SEQ ID NO: 90 - protein, 288 aa, Artificial Sequence
  Description of Artificial Sequence: Synthetic peptide
MSHTRRQGTSPSKCPYLKFFQLLVLAGLSHLCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVMLSVKADFPTPSISDFEIPTSNIRRIICSTSGGFPEPHLSWLENGEELNAINTTVSQDPETELYTVSSKLDFNMTANHSFVCLIKYGHLRVNQTFNWNTPKQEHFPDNLLPSWAITLISVNGIFVICCLTYCFAPRCRERRRNERLRRESVRPV

SEQ ID NO: 91 - protein, 288 aa, Artificial Sequence
  Description of Artificial Sequence: Synthetic peptide
MGHTRRQGISPSKCPYLNFFQLLVLACLSHFCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVMLSVKADFPTPSITDFEIPPSNIRRIICSASGGFPEPHLFWLENGEELNAINTTVSQDPETELYAVSSKLDFNMTTNHSFMCLIRYGHLRVNQTFNWNTPKQEHFPDNLLPSWAITLISVNGIFVICCLTYCFAPRCRERKSNERLRRESVRPV

SEQ ID NO: 92 - protein, 288 aa, Artificial Sequence
  Description of Artificial Sequence: Synthetic peptide
MGHTRRQGTSPSKCPYLNFFQLLVLACLSHFCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVMLSVKADFPTPSITDFEIPPSNIRRIICSTSGGFPEPHLSWLENGEELNAINTTASQDPETELYTVSSKLDFNMTTNHSFMCLIKYGHLRVNQTFNWNTPKQEHFPDNLLPSWAITLISVNGIFVICCLTYCFAPRCRERKSNERLRRESVRPV

SEQ ID NO: 93 - protein, 288 aa, Papio sp.
MGHTRRQGISPSKCPYLKFFQLLVLACLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVMLSVKADFPTPSITDFEIPPSNIRRIICSTSGGFPEPHLFWLENGEELNAINTTVSQDPGTELYTVSSKLDFNMTTNHSFVCLIKYGHLRVNQTFNWNTPKQEHFPDNLLPSWAITLISVNGIFVICCLTYCFAPRCRERRRNETLRRESVRPV

SEQ ID NO: 94 - protein, 288 aa, Pongo pygmaeus
MGHTRRQGTSPSKCPYLNFFQLLVLASLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRMICSTSGGFPEPHLSWLENGEELNAISTTVSQDPETELYAVSSKLDFNMTTNHSFMCLIKYGHLRVNQTFNWNTPKQEHFPDNLLPSWAITLISVNGIFVICCLTYCFAPRCRERRSNERLRRESVRPV

SEQ ID NO: 95 - DNA, 912 bp, Artificial Sequence
  Description of Artificial Sequence: Synthetic nucleotide sequence
  modified_base (213): A, T, C, G, other or unknown
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcgaaaggatagtaaaatgntgctggccatcctgcctggaaaagtgcaggtgtggcctgagtacaagaaccgtaccatcactgacatgaacgataacctccgtattgtgatcctggctctgcgcctgtcggacagtggcacctacacctgtgttattcagaagcctgatttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgttggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 96 - DNA, 912 bp, Artificial Sequence
  Description of Artificial Sequence: Synthetic nucleotide sequence
atgggtcacacaatgaagtggggatcactaccacccaagtgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaaccgaaaggctgtcccctatctacttaggctctgcgcaatcctcgggctga

SEQ ID NO: 97 - DNA, 930 bp, Artificial Sequence
  Description of Artificial Sequence: Synthetic nucleotide sequence
  modified_base (929): A, T, C, G, other or unknown
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaaaaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctgaaaccaagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcccggcctgcagacatgttgcgaggtggaaaagaacaagaaggaatgaagagacagtgggaactgaaaggctgtcccctatctacttaggctctgcgcaatctcgggctgaggtaccaagcttaagttna

SEQ ID NO: 98 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattcttggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 99 - DNA, 912 bp, Artificial Sequence
  Description of Artificial Sequence: Synthetic nucleotide sequence
atgggtcacacaatgaagtggggatcactaccacccaagcgcccatgcctctggctccctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctgaaaccaagctctacatgattagcagtgaactggatttcaatgtgacaaataaccacagcattgtgtgtctcatcaaatacggggagctgtcggtgtcacagatcttcccttggagcaaacccaagcaggagcctcccattgatcagcttccattccgggtcattatcccagtaagtggtgctttggtgctcactgcgatagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 100 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctag

SEQ ID NO: 101 - DNA, 909 bp, Artificial Sequence
  Description of Artificial Sequence: Synthetic nucleotide sequence
atgggtcacacaatgaagtggggatcactaccacccaagcgcccatgcctctggctctcccagctcttggtgctcactggtcttttttacttctgttcaggcatcaccccaaagagtgtgaccaaaagagtgaaagaaacagtaatgccatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgcgtggttcagaagaatgagaacgggtctttcagacgggagcacctgacctccgtgacactgtccatcagagctgacttccctgtccctagcataactgacattggacatcccgcccctaatgtgaaaaggataagatgctccgcctctggaggttttccagagcctcgcctcgcctggatggaagatggagaagaactaaacgccgtcaacacaacggttgaccaggatttggacacggagctctacagcgtcagcagtgagctggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 102 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacaagggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacgagaaggaatgaagagacagtgggaactgaaaggctgtcccctatctacttaggctctgcgcaatcctcgggctga

SEQ ID NO: 103 - DNA, 891 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaacatgacaagcaatcacagcttcttgtgtcttgtcaagtatggagacttaacagtgtcacagaccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtggaaatgcaaagttgctctcagtctccatag

SEQ ID NO: 104 - DNA, 892 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgatttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaacatgacaagcaatcacagcttcttgtgtcttgtcaagtatggagacttaacagtgtcacagaccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtgaaaatgcaaagttgctctcagtctccatgag

SEQ ID NO: 105 - DNA, 828 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacaagggcacctacacctgtgttattcagaagcctgttttgaaaggggcttataaactggagcacctgacctccgtgacactgtccatcagagctgacttccctgtccctagcataactgacattggacatcccgcccctaatgtgaaaaggataagatgctccgcctctggaggttttccagagcctcgcctcgcctggatggaagatggagaagaactaaacgccgtcaacacgacggttgaccaggatttggacacggagctctacagcgtcagcagtgaactggatttcaatgcgacaaataaccacagcatcgtgtgtctcatcaaatacggggagctgtcggtgtcacagatcttcccttggagcaaacccaagcaggagcctcccattgatcagcttccattctgggtcattgtcccagtaagtggtgctttggtgctcactgcggtagttctctactgcctggcctgcagacatgttgcgaggtga

SEQ ID NO: 106 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcacaatcctcgggctga

SEQ ID NO: 107 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgcgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctag

SEQ ID NO: 108 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatggtgcgaggtggaaaagaacaagaaggaatgaagagacagtgggaactgaaaggctgtcccctatctacttaggctctgcgcaatcctcgggctga

SEQ ID NO: 109 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgatttgaaaggggcttataaactggagcacctgacttccgtgaggttaatgatcagagctgacttccctgtccctagcataactgacattggacatcccgcccctaatgtgaaaaggataagatgctccgcctctggagattttccagagcctcgcctcgcctggatggaagatggagaagaactaaacgccgtcaacacgacggttgaccaggatttggacacggagctctacagcgtcagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 110 - DNA, 913 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactgggtttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctgag

SEQ ID NO: 111 - DNA, 912 bp, Artificial Sequence
  Description of Artificial Sequence: Synthetic nucleotide sequence
  modified_base (827): A, T, C, G, other or unknown
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttctgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtngaaaagaacaagaaggaatgaagagacagtgggaactgaaaggctgtcccctatctacttaggctctgcgcaatcctcgggctag

SEQ ID NO: 112 - DNA, 882 bp, Artificial Sequence
  Description of Artificial Sequence: Synthetic nucleotide sequence
atgggccacacgctgaggccgggaactccactgcccaggtgtctacacctcaagctctgcctgctcttggcgctggcgggtctccacttctcttcaggtatcagccaggtcaccaagtcggtgaaagaaatggcagcactgtcctgtgattacaacatttctatcgatgaactggcgagaatgcgcatatactggcagaaggaccaacagatggtgctgagcatcatctctgggcaagtggaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaaccggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaacatgacaagcaatcacagcttcttgtgtcttgtcaagtatggagacttaacagtgtcacagaccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtggaaatgcaaagttgctctcagtctccatag

SEQ ID NO: 113 - DNA, 906 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatccaggctctgcgcctgtcggacagtggcacctacacctgtgttatccagaagcctgttttgaaaggggcttataaactggagcacctggcttccgtgaggttaatgatcagagctgacttccctgtccctactgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 114 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 115 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 116 - DNA, 910 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgcgtggttcagaagaatgagaacgggtctttcagacgggagcacctgacctccgtgacactgtccatcagagctgacttccctgtccctagcataactgacattggacatcccgcccctaatgtgaaaaggataagatgctccgcctctggagattttccagagcctcgcctcgcctggatggaagatggagaagaactaaacgccgtcaacacgacggttgaccaggatttggacacggagctctacagcgtcagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcctagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctgag

SEQ ID NO: 117 - DNA, 903 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctagcataactgacattggacatcccgcccctaatgtgaaaaggataagatgctccgcctctggagattttccagagcctcgcctcgcctggatggaagatggagaagaactaaacgccgtcaacacgacggttttggacacggagctctacagcgtcagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaaccctcgggctga

SEQ ID NO: 118 - DNA, 912 bp, Artificial Sequence
  Description of Artificial Sequence: Synthetic nucleotide sequence
atgggtcacacaatggagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttagaaaatggagaagaattaaatgctaccaacacaacactgtcccaagatcctgaaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 119 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcccggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccagagcctcgcctcgcctggatggaagatggagaagaactaaacgccgtcaacacgacggttgaccaggatttggacacggagctctacagcgtcagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 120 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcagtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 121 - DNA, 913 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgatttgaaaggggcttataaactggagcacctgacttccgtgaggttaatgatcagagctgacttccctgtccctagcataactgacattggacatcccgcccctaatgtgaaaaggataagatgctccgcctctggagattttccagagcctcgcctcgcctggatggaagatggagaagaactaaacgccgtcaacacgacggttgaccaggatttggacacggagctctacagcgtcagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctgag

SEQ ID NO: 122 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgatttgaaaggggcttataaactggagcacctggcttccgtgaggttaatgatcagagctgacttccctgtccctagcataactgacattggacatcccgcccctaatgtgaaaaggataagatgctccgcctctggagattttccagagcctcgcctcgcctggatggaagatggggaagaactaaacgccgtcaacacgacggttgaccaggatttggacacggagctctacagcgtcagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagcggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctag

SEQ ID NO: 123 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctagcataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctccgcgcaatcctcgggctga

SEQ ID NO: 124 - DNA, 909 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaaaaaccgcaccttccccgacatcattaacaacctctcccttatgatcctggcactgcgcctgtcggacaagggcacctacacctgcgtggttcagaagaatgagaacgggtctttcagacgggagcacctgacctccgtgacactgtccatcagagctgacttccctgtctctagcataactgacattggacatcccgcccctaatgtgaaaaggataagatgctccgcctctggaggttttccagagcctcgcctcgcctggatggaagatggagaagaactaaacgccgtcaacacgacggttgaccaggatttggacacggagctctacagcgtcagcagtgaactggatttcaatgtgacaaataaccacagcattgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 125 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctgacttccgtgaggttaatgatcagagctgacttccctgtccctagcataactgacattggacatcccgcccctaatgtgaaaaggataagatgctccgcctctggaggttttccagagcctcgcctcgcctggatggaagatggagaagaactaaacgccgtcaacacgacggttgaccaggatttggacacggagctctacagcgtcagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 126 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactgatcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcaaggtggaaaagaacaagaaggaatgaagagacagtgggaactgaaaggctgtcccctatctacttaggctctgcgcaatcctcgggctga

SEQ ID NO: 127 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggcagttctctactgcctggcctgcagacatgttgcgaggtggaaaagaacaagaaggaatgaagagacagtgggaactgaaaggctgtcccctatctacttaggctctgcgcaatcctcgggctag

SEQ ID NO: 128 - DNA, 903 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttaaaaggggcttataaactggagcacctggcttccgtgaggttaatgatcagagctgacttccctgtccctaccataaatgatcttggaaatccatctcctaatatcagaaggctaatttgctcaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 129 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggcactgcgcctgtcggacaagggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 130 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctag

SEQ ID NO: 131 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgatttgaaaggggcttataaactggagcacctggcttccgtgaggttaatgatcagagctgacttccctgtccctagcataactgacattggacatcccgcccctaatgtgaaaaggataagatgctccgcctctggaggttttccagagcctcgcctcgcctggatggaagatggagaagaactaaacgccgtcaacacgacggttgaccaggatttggacacggagctctacagcgtcagcagtgaactggatttcaacatgacaagcaatcacagcttcttgtgtcttgtcaagtatggagacttaacagtgtcacagaccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagggaaatgcaaagtgctctcagtctccataggtaccaagcttaagtttaaccgc

SEQ ID NO: 132 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacaagggcacctacacctgcgtggttcagaagcctgatttgaaaggggcttataaactggagcacctggcttccgtgaggttaatgatcagagctgacttccctgtccctagcataactgacattggacatcccgcccctaatgtgaaaaggataagatgctccgcctctggaggttttccagagcctcgcctcgcctggatggaagatggagaagaactaaacgccgtcaacacgacggttgaccaggatttggacacggagctctacagcgtcagcagtgaactggatttcaatgtgacaaataaccacagcatcgtgtgtctcatcaaatacggggagctgtcggtgtcacagatctttccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 133 - DNA, 891 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaacatgacaagcaatcacagcttcttgtgtcttgtcaagtatggagacttaacagtgtcacagtccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtggaaatgcaaagttgctctcagtctccatga

SEQ ID NO: 134 - DNA, 909 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacaagggcacctacacctgcgtggttcagaagaatgagaacgggtctttcagacgggagcacctgacctccgtgacactgtccatcagagctgacttccctgtccctagcataactgacattggacatcccgcccctaatgtgaaaaggataagatgctccgcctctggaggttttccagagcctcgcctcgcctggatggaagatggagaagaactaaacgccgtcaacacgacggttgaccaggatttggacacggagctctacagcgtcagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctag

SEQ ID NO: 135 - DNA, 891 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcaccaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcccgtcggacagtggcacctacacctgtgttattcagaagcctgttttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaacatgacaagcaatcacagcttcttgtgtcttgtcaagtatggagacttaacagtgtcacagaccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtggaaatgcaaagttgctctcagtctccatga

SEQ ID NO: 136 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgatttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaatgtgacaaataaccgcagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 137 - DNA, 891 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctgaaaccaagctctacatgattagcagtgaactggatttcaacacgacaagcaatcacagcttcttgtgtcttgtcaagtatggagacttaacagtgtcacagaccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtggaaatgcaaagttgctctcagtctccatga

SEQ ID NO: 138 - DNA, 912 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacaagggcacctacacctgtgttattcagaagcctgatttgaaaggggcttataaactggagcacctggcttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcaggcatgttgcgaggtggaaaagaacaagaaggaatgaagagacagtgggaactgaaaggctgtcccctatctacttaggctctgcgcaatcctcgggctga

SEQ ID NO: 139 - DNA, 891 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgatttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggaaaagaattaaatgctaccaacacaacactgtcccaagatcctgaaaccaagctctacatgattagcagtgaactggatttcaacatgacaagcaatcacagcttcttgtgtcttgtcaagtatggagacttaacagtgtcacagaccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtggaaatgcaaagttgctctcagtctccatga

SEQ ID NO: 140 - DNA, 910 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgcgtggttcagaagaatgagaacgggtctttcagacgggagcacctgacctccgtgacactgtccatcagagctgacttccctgtccctagcataactgacattggacatcccgcccctaatgtgaaaaggataagatgctccgcctctggaggttttccagagcctcgcctcgcctggatggaagatggagaagaactaaacgccgtcaacacgacggttgaccaggatttggacacggagctctacagcgtcagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctgag

SEQ ID NO: 141 - DNA, 912 bp, Artificial Sequence
  Description of Artificial Sequence: Synthetic nucleotide sequence
atgggtcacacaatgaagtggggatcactaccacccaagcgcccatgcctccggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgatttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 142 - DNA, 882 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgttttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaacatgacaagcaatttgtgtcttgtcaagtatggagacttaacagtgtcacagaccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtggaaatgcaaagttgctctcagtctccatga

SEQ ID NO: 143 - DNA, 867 bp, Artificial Sequence
  Description of Artificial Sequence: Synthetic nucleotide sequence
atgagccacacacggaggcagggaacatcaccatccaagtgtccgtacctcaagttctttcagttcttggtgctggctagtctttctcatttctgttcaggtgttatccacgtgactaaggaagtgaaagaagtggcaacgctgtcctgtggtctcaatgtttctgttgaagagctggcacaaactcgcatctactggcaaaaggggaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctggagtatgaaaaagatgctttcaagcgagaacacctggctgaagtgatgttatccgtcaaagctgacttccctacacctagtatatctgactttgaaattccaccttctaacattagaaggataatttgctcaacctccggaggttttcctgagcctcacctctcctggctggaaaatggagaagaattaaatgccatcaacacaacagcttcccaagatcctggaactgagctctatactgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacccactgttttgccccaagatgcagagagagaaggaggaatgagagattgagaagggaaagtgcacgccctgtatga

SEQ ID NO: 144 - DNA, 868 bp, Artificial Sequence
  Description of Artificial Sequence: Synthetic nucleotide sequence
atgggctacacacggaggcagggaacatcaccatccaagtgtccgtacctcaagttctttcagctcttggtgctggctagtctttctcatttctgttcaggtgttatccacgtgaccaaggaagtgaaagaagtggcaacgctgtcctgtggtcacaatgtttctgttgaagagctggcacaaactcccatctactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgagaacacctggctgaagtgatgttatccgtcaaagctgacttccctacacctagtataactgactttgaaattccaccttctaacattagaaggataatttgctcaacctccggaggttttcctgagcctcacctcttctggctggaaaatggagaagaattaaatgccatcaacacaacagtttcccaagatcctgaaactgagctctatactgttagcagcaaactggatttcaatatgacaaccaatcgcagttttgtgtgtctcatcaagtatggacatttaagagtgaatcagaccttcaactggaatacacccaagcaagagcattttcctgataacctgctcccatcctgggccattaccttaatctcagcaaatggaatttttgtgatatgctgcctgacctaccgctttgccccaagatgcagagagagaaggaggaatgagaggctgagaagggaaagtgtatgccctgtatgag

SEQ ID NO: 145 - DNA, 867 bp, Artificial Sequence
  Description of Artificial Sequence: Synthetic nucleotide sequence
atgggctacacacggaggcagggaatatcaccatccaagtgtccatacctcaagttctttcagctcttggtgctggctagtctttcccacttctgttcaggtgttatccacgtgaccaagaaagtgaaagaagtggcaacgctgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgaatgtgttgttctgaagtatgaaaaagatgctttcaagcgggaacacctggctgaagtgatgttatccgtcaaagctgacttccctacacctagtatatctgactttgaaattccaccttctaacattagaaggataatttgctcaacctctggaggttttccagagcctcacctctcctggctggaaaatggagaagaattaaatgccatcaacacaacagtttcccaagatcctggaactgagctctatactgttagcagcaaactggatttcaatatgacaaccgatcgcagttttgtgtgtctcatcaagtatggacatttaagagtgaatcagaccttcaactggaatacacccaagcaagagcattttcctgataacctgctcccatcctgggccattaccctaatctcagtaaatggaatttttgtgatatgctgcctgacctactgctttgccccaagatgcagagagagaaggaggaatgggagattgagaagggaaagtgtacgccctgtatga

SEQ ID NO: 146 - DNA, 868 bp, Artificial Sequence
  Description of Artificial Sequence: Synthetic nucleotide sequence
atgagccacacacagaggcagggaatatcaccatccaagtgtccatacctcaatttctttcagctcttggtgctggctagtctttctcatttctgttcaggtgttatccacgtgaccaaggaagtgaaagaagtggcaacactgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctggagtatgaaaaagacgctttcaagcgggagcacctagctgaagtgacgttatcagtcaaagctgacttccctacacctagtataactgactttgaaattccaccttctaacattagaaggataatttgctcaacctctggaggttttccagagccccacctcttctggctggaaaatggagaagaattaaatgccatcagcacaacagtttcccaagatcctgaaactgagctctatgctgtcagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagaggagaaggaatgagagattgagaagggaaagtgtacaccctgtatgag

SEQ ID NO: 147 - DNA, 867 bp, Artificial Sequence
  Description of Artificial Sequence: Synthetic nucleotide sequence
atgggccacacacggaggcagggaacatcaccatccaagtgtccatacctcaagttctttcagctcttggtgctggctggtctttctcatctctgttcaggtgttatccacgtgaccaaggaagtgaaagaagtggcaacactgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctggagtatgaaaaagacgctttcaagcgggaacacctagctgaagtgacgttatcagtcaaagctgacttccctacacctagtatatctgactttgaaattccgacttctaatattagaaggataatttgctcaacctctggaggttttccagagcctcacctcttctggctggaaaatggagaagaattaaatgccatcaacacaacagtttcccaagatcctgaaactgagctctatactgttagcagcaaactggatttcaatatgacagccaatcacagttttgtgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctactgctttgccccaggatgcagagagagaaggaggaatgagagattgagaagggaaagtgtatgccctgtatag

SEQ ID NO: 148 - DNA, 867 bp, Artificial Sequence
  Description of Artificial Sequence: Synthetic nucleotide sequence
atgagccacatacggaggcagggaatatcaccatccaagtgtccatacctcaatttctttcagctcttggtgctggcttgtctttctcatttctgttcaggtgttatccacgtgaccaaggaagtgaaagaagtggcaacactgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgattctggctctgcgcccatccgacgagggcacatacgagtgtgttgttctgaagtatgaaaaagacgctttcaagcgggaacacctggctgaagtgacgttatcagtcaaagctgacttccctacacctagtatatctgactttgaaattccaccttctaacattagaaggataatttgctcaacctctggaggttttccagagcctcgcctcgcctggatggaagatggagaagaactaaatgccatcaacacaacagcttcccaagatcctgaaactgagctctatactgttagcagcaaactggatttcaatatgacaaccaatcgcagttttgtgtgtctcatcaagtatggacatttaagagtgaatcagaccttcaactggaatacacccaagcaagagcattttcctgataacctgttcccatcctgggccattaccctaatctcagtaaatggaatttttgtgatatgctgcctgacctactgctttgccccaagatgcagagagagaaggaggaatgagagattgagaagggaaagtgtacgccctgtatga

SEQ ID NO: 149 - DNA, 867 bp, Artificial Sequence
  Description of Artificial Sequence: Synthetic nucleotide sequence
atgagccacacacggaggcagggaacatcaccatccaagtgtccgtacctcaagttctttcagctcttggtgctggctagtctttctcacttctgttcaggtgttatccacatgaccaaggaagtgaaagaagtggcaacgctgtcctgtggtcccaatgtttccgttgaagagctggcacaaactcgcatctactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagatgctttcaagcgagaacacctggctgaagtgacgttatcagtcaaagctgacttccctacacctagtatatctgactttgaaattccaacttctaacattagaaggataatttgctcaacctctggaggttttcctgagcctcacctctcctggctggaaaatggagaagaattaaatgccatcaacacaacagtttcccaagatcctggaactgagctctatactgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacccactgttttgccccaagatgcagagagagaaggaggaatgagagattgagaagggaaagtgtatgccctgtatag

SEQ ID NO: 150 - DNA, 867 bp, Artificial Sequence
  Description of Artificial Sequence: Synthetic nucleotide sequence
atgagccacacacggaggcagggaatatcatcatccaagtgtccatacctcaagttctttcagctcttggtgctggcttgtctttctcatttctgttcaggtgttatccacgtgaccaagaaagtgaaagaagtggcaacactgtcctgtggtcacaatgtttctgttgaagagctggcacaaactcgcatctactggcaaaaggggaagaaaatggtgctgactatgatgtctggggacatgaatatatggcccgagtgcaagaaccggaccatctttgatatcactaataacctctccattgtgattctggctctgcgcccatctgacgagggcacatacgagtgtgctgttctgaagtatgaaaaagacgctttcaagcgggaacacctagctgaagtgacgttatcagtcaaagctgacttccctacacctagtatatctgactttgaaattccaacttctaatattagaaggataatttgctcaacctctggaggttttccagagcctcacctcttctggttggaaaatggggaagaattaaatgccatcaacacaacagcttcccaagatcctgaaactgagctctatgctgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctactgctttgccccaagatgcagagagagaaagagcaatgagagactgagaagggaaagtgtacgccctgtatga

SEQ ID NO: 151 - DNA, 867 bp, Artificial Sequence
  Description of Artificial Sequence: Synthetic nucleotide sequence
atgggctacacacggaggcagggaacatcaccatccgagtgtccatacctcaagttctttcagctcttggtgctggctggtctttctcacttctgttcaggtgttatccacatgaccaaggaagtgaaagaagtggcaacactgtcctgtggtctcaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagatgccttcaagcgggaacacctggctgaagtgatgttatcagtcaaagctgacttccctacacctagtatatctgactttgaaattccaccttctaacattagaaggataatttgctcaacctctggaggttttcctgagcctcacctctcctggctggaaaatggagaagaattaaatgccatcaacacaacagtttcccaagatcctgaaactgggctctatactgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccctaatctcagtaaatggaatttttgtgatatgctgcctgacctactgctttgccccaagatgcagagagagaaggaggaatgagagactgagaagggaaagtgtacgccctgtatga

SEQ ID NO: 152 - DNA, 867 bp, Artificial Sequence
  Description of Artificial Sequence: Synthetic nucleotide sequence
atgagccacacacggaggcagggaatatcaccatccaagtgtccatacctcaatttctttcggctcttggtgctggctagtctttctcatttctgttcaggtgttatccacgtgaccaaggaagtgaaagaagtggcaacactgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgagaacacctagctgaagtgacgttatcagtcaaagctgacttccctacacctagtataactgactttgaaattccaccttctaacattagaaggataatttgctcaacctctggaggttttccagagcctcacctctcctggctggaaaatggagaagaattaaatgccatcaacacaacagtttcccaagatcctggaactgagctctatactgttagcagcaaactggatttcaatatgacagccaatcacagttttgtgtgtctcatcaagtatggacatttaagagtgaatcagaccttcaactggaatacacccaagcaagagcattttcctgataacctgctcccatcctgggccattaccttaatctcagcaaatggaatttttgtgatatgctgcctgacctactgctttgccccaagatgcagagagagaaggaggaatgagagattgagaagggaaagtgtacgccctgtatga

SEQ ID NO: 153 - DNA, 901 bp, Artificial Sequence
  Description of Artificial Sequence: Synthetic nucleotide sequence
  modified_base (893)..(894): A, T, C, G, other or unknown
atgagccacacacggaggcagggaatatcaccatccaagtgtccatacctcaagttctttcagctcttggtgctggctagtctttctcatttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagcacaagaaccggaccatctttgatatcactaataacctctccattgtgattctggctctgcgcccatctgacgagggcacatacgagtgtgttgttctgaagtatgaaaaagacgctttcaagcgggaacacctggctgaagtgatgttatccgtcaaagctgacttccctacacctagtatatctgactttgaaattccaccttctaacattagaaggataatttgctcaacctccggaggttttcctgagcctcacctctcctggctggaaaatggagaagaattaaatgccatcaacacaacagtttcccaagatcctgaaactgagctctatactggtagcagcaaactggatttcaatatgacaaccaaccacagcttcatgtgtctcatcaagtatggacatttaagagtgaatcagaccttcagctggaatacacccaagcaagagcattttcctgataacctgctcccatcctgggccattaccctaatctcagcaaatggaatttttgtgatatgctgcctgacctactgctttgccccaagatgcagagagagaaggaggaatgagaccctgagaagggaaagtgtacgccctgtatggggtaccaagcttaagtttaaaccgcnnatcagcc

SEQ ID NO: 154 - DNA, 867 bp, Artificial Sequence
  Description of Artificial Sequence: Synthetic nucleotide sequence
atgggccacacacggaggcagggaatatcaccatccaagtgtccatacctcaagttctttcagctcttggtgctggctagtctttctcatttctgttcaggtgttatccacgtgactaaggaagtgaaagaagtggcaacgctgtcctgtggtctcaatgtttctgttgaagagctggcacaaactcgcatctactggcaaaaggagaagaaaatggtgctgactatgatgtctggggacatgaatatatggcccgagcacaagaaccggaccatctttgatatcactaataacctctccattgtgattctggctctgcgcccatctgacgagggcacatacgagtgtgttgttctgaagtatgaaaaagacgctttcaagcgggaacacctagctgaagtgacgttatcagtcaaagctgacttccctacacctagtataactgactttgaaattccaccttctaacattagaaggataatttgctcaacctccggaggttttcctgagcctcacctcttctggctggaaaatggagaagaattaaacgccatcaacacaacagcttcccaagatcctgaaactgagctctatactgttagcagcaaactggatttcaatatgacagccaatcacagttttgtgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctactgctttgccccaagatgcagagagaggagaaggaatgagacactgagaagggaaagtgtacgccctgtatga

SEQ ID NO: 155 - DNA, 867 bp, Artificial Sequence
  Description of Artificial Sequence: Synthetic nucleotide sequence
atgggctacacacggaggcagggaacatcaccatccaagtgtccatacctcaatttctttcagctcttggtgctagctagtctttctcacttctgttcaggtgttatccacgtgaccaaggaagtgaaagaagtggcaacgctgtcctgtggtcacaatgttcctgttgaagagctggcacaaactcgcatctactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgggtgtgttgttctggagtatgaaaaagacgctttcaagcgagaacacctggctgaagtgatgttatccgtcaaagctgacttccctacacctagtataactgaccttgaaattccaccttctaacattagaaggataatttgctcaacctctggaggttttccagagcctcacctcttctggttggaaaatggggaagaattaaatgccatcaacacaacagcttcccaagatcctgaaactgagctctatgctgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccttaatctcagcaaatggaatttttgtgatatgctgcctgacttactgctttgccccaagatgcagagagagaaggaggaatgagagattgagaagggaaagtgtacaccctgtatga

SEQ ID NO: 156 - DNA, 867 bp, Artificial Sequence
  Description of Artificial Sequence: Synthetic nucleotide sequence
atgggccacacacggaggcagggaatatcaccatccaagtgtccatacctcaagttctttcagctcttggtgctggcttgtctttctcatttctgttcaggtgttatccacgtgaccaaggaagtgaaagaggtggcaacgctgtcctgtggtcacaatgtttctgttgaagagctggcacaaactcgcatctactggcaaaaggataagaaaatggtgctgactatgatgtctggggacatgaatatatggcccgagtacaagaaccagaccatctttgatatcactaataacctctccattgtgattctggctctgcgcccatctgacgagggcacatacgagtgtgttgttctgaagtatgaaaaagatgctttcaagcaggaacacctggctgaagtgatgttatccgtcaaagctgacttccctacacctagtatatctgactttgaaattccaccttctaacattagaaggataatttgctcaacctctggaggttttccagagcctcgcctcgcctggatggaagatggagaagaactaaatgccatcagcacaacagtttcccaagatcctggaactgagctctgtactgttagcagcaaactggatttcaatatgacaaccaaccacagcttcatgtgtctcatcaggtatggacatttaagagtgaatcagaccttcaactggaatacacccaagcaagagcattttcctgataacctgctcccatcctgggccattaccttaatctcagtaaagggaatttttgtgatatgctgcctgacctactgctttgccccaagaggcagagagagaaagagcaatgggagactgagaagggaaagtgtacaccctgtatga

SEQ ID NO: 157 - DNA, 867 bp, Artificial Sequence
  Description of Artificial Sequence: Synthetic nucleotide sequence
  modified_base (599): A, T, C, G, other or unknown
atgggccacacacggaggcagggaacatcaccatccaagtgtccatacctcaagttctttcagctcttggtgctggctggtctttctcacttctgttcaggtgttatccacgtgactaaggaagtgaaagaagtggcaacgctgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagatgctttcaagcgggaacacctggctgaagtgatgttatccgtcaaagctgacttccctacacctagtatatctgactttgaaattccaccttctaacattagaaggataatttgctcaacctctggaggttttcctgagcctcacctcttctggctggaaaatggagaagaattaaatgccatcagcacaacagtttcccaagatcctgaaactgagctctatgctgntagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccctaatctcggtaaatggaatttttgtgatatgctgcccgacctactgctttgccccaaggtgcagagagagaaggaggaatgagagattgagaagggaaagtgtatgccctgtatga

SEQ ID NO: 158 - DNA, 867 bp, Artificial Sequence
  Description of Artificial Sequence: Synthetic nucleotide sequence
atgggccacacacggaggcagggaatatcaccatccaagtgtccatacctcaagttctttcagctcttggtgctggcttgtctttctcatttctgttcaggtgttatctacgtgaccaaggaagtgaaagaagtggcaacgctgtcctgtggtcacaatgtttctgttgaagagctggcacaaactcgcatctactggcaaaaggagaagaaaatggtgctgattatgatgtctggggacatgaatatatggcccgagtacaagaaccggaccatctttgatatcactaataacctctccattgtgattctggctctgcgcccatctgacgagggcacataggagtgtgttgttctgaagtatgaaaaagatgctttcaagcgggaacacctggctgaagtgacgttatcagtcaaagctgacttccctacacctagtatatctgactttgaaattccaccttctaacattagaaggataatttgctcaacctctggaggttttcctgagcctcacctctcctggctggaaaatggagaagaattaaatgccatcaacacaacagtttcccaagatcctggaactgagctctatactgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtatgccctgtatga

SEQ ID NO: 159 - DNA, 867 bp, Artificial Sequence
  Description of Artificial Sequence: Synthetic nucleotide sequence
atgggccacacacggaggcagggaacatcaccatccaagtgtccatacctcaagttctttcagctcttggtgctggctggtctttctcacttctgttcaggtgttatccacgtgaccaaggaagtgaaagaagtggcaacactgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgggtgtgttgttctggagtatgaaaaagacgctttcaagcgggaacacctggctgaagtgatgttatccgtcaaagctgacttccctacacctagtatatctgactttgaaattccaccttctaacattagaaggataatttgctcaacctctggaggttttccagagcctcacctctcctggctggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagcgaatcagaccttcaactggaatacacccaagcaagagcattttcctgataacctgctcccatcctgggccattaccctaatctcagtaaatggaatttttgtgatatgctgcctgacctactgctttgccccaagatgcagagagagaaggaggaatgagagattgagaagggaaagtgtacgccctgtatga

SEQ ID NO: 160 - DNA, 867 bp, Artificial Sequence
  Description of Artificial Sequence: Synthetic nucleotide sequence
atgggctacacacggaggcagggaacatcaccatccaagtgtccatacctcaatttctttcagctcttggtgctggctagtctttctcacttctgttcaggtgttatccacgtgaccaaggaagtgaaagaagtggcaacactgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccgttgtgattctggctctgcgcccatctgacgagggcacatacgagtgtgttgttctgaagtatgaaaaagacgctttcaagcgggaacacctggctgaagtgacgttatcagtcaaagctgacttccctacacctagtataactgactttgaaattccaccttctaacattagaaggataatttgctcaacctctggaggttttcctgagcctcacctctcctggctggaaaatggagaagaattaaatgccatcaacacaacagtttcccaagatcctggaactgagctctatactgttagcagcaaactggatttcaatatgacaaccaatcgcagttttgtgtgtctcatcaagtatggacatttaagagtgaatcagaccttcaactggaatacacccaagcaagagcattttcctgataacctgctcccatcctgggccattaccctaatctcagtaaatggaatttttgtgatatgctgcctgacctactgctttgccccaagatgcagagagagaaagagcaatgagagactgagaagggaaagtgtacgccctgtatga

SEQ ID NO: 161 - DNA, 867 bp, Artificial Sequence
  Description of Artificial Sequence: Synthetic nucleotide sequence
atgggctacacacggaggcagggaatatcaccatccaagtgtccatacctcaagttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagatgctttcaagcgggaacacctggctgaagtgatgttatccgtcaaagctgacttccctacacctagtataactgactttgaaattccaccttctaacattagaaggataatttgctcaacctctggaggttttccagagcctcgcctcgcctggatggaagatggagaagaattaaatgccatcaacacaacagtttcccaagatcctggaactgagctctatgctgttagcagcaaactggattttaatatgacaaccaaccacagcttcatgtgtctcatcaagtatggacatttaagagtgaatcagaccttcaactggaatacacccaagcaagagcattttcctgataacctgctcccatcctgggccattaccttaatctcagtaaatggaatttctgtgatatgctgcctgacctactgctttgccccaagatgcagagagagaaggaggaatgagagattgagaagggaaagtgtatgccctgtatga

SEQ ID NO: 162 - DNA, 867 bp, Artificial Sequence
  Description of Artificial Sequence: Synthetic nucleotide sequence
atgagccacacacggaggcagggaatatcaccatccaagtgtccatacctcaagttctttcagctcttggtgctggctggtctttctcacttctgttcaggtgttatccacgtgaccaaggaagtgaaagaagtggcaacgctgtcctgtggtcacaatgtttctgctgaagagctggcacaaactcgcatctactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctggagtatgaaaaagatgctttcaagcgggaacacctggctgaagtgatgttatccgtcaaagctgacttccctacacctagtataactgactttgaaattccaacttctaacattagaaggataatttgctcaacctctggaggttttccagagcctcgcctcgcctggatggaagatggagaagaactaaatgccatcagcacaacagcttcccaagatcctgaaactgagctctatactgttagcagcaaactggatttcaatatgacaactaaccacagcttcatgtgtctcatcaagtatggacatttaagagtgaatcagaccttcaactggaatacacccaagcaagagcattttcctgataacctgctcccatcctgggccattaccctaatctcagtaaatggaatttttgtgatatgctgcctgacccactgttttgccccaagatgcagagagagaaggaggaatgagagattgagaagggaaagtgtatgccctgtatga

SEQ ID NO: 163 - DNA, 867 bp, Artificial Sequence
  Description of Artificial Sequence: Synthetic nucleotide sequence
atgggccacacacggaggcagggaatatcaccatccaagtgtccatacctcaagttctttcagctcttggtgctggctggtctttctcacttctgttcaggtgttatccacgtgaccaaggaagtgaaagaagtggcaacgctgtcctgtggtctcaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgggaacacctggctgaagtgatgttatccgtcaaagctgacttccctacacctagtataactgactttgaaattccaccttctaacattagaaggataatttgctcaacctctggaggttttcctgagcctcacctctcctggctggaaaatggagaagaattaaatgccatcaacacaacagtttcccaagatcctggaactgagctctatactgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccttaatctcagcaaatggaatttttgtgatatgctgcctgacctactgctttgccccaagatgcagagagagaaagagcaatgagagactgagaagggaaagtgtatgccctgtatga

SEQ ID NO: 164 - DNA, 867 bp, Artificial Sequence
  Description of Artificial Sequence: Synthetic nucleotide sequence
atgggctacacacggaggcagggaatatcaccatccaagtgtccatacctcaagttctttcagctcttggtgctggcttgtctttctcatttctgttcaggtgttatccacgtgaccaaggaagtgaaagaagtggcaacactgtcctgtggtcacaatgtttctgatgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagatgctttcaagcgagaacacctggctgaagtgacgttatcagtcaaagctgacttccctacacctagtatatctgactttgaaattccaccttctaacattagaaggataatttgctcaacctctggaggttttcctgagcctcacctctcctggctggaaaatggggaagaattaaatgccatcaacacaacagtttcccaagatcctggaactgagctctatactgttagcagcaaactggatttcaatatgacaaccaaccacagcttcatgtgtctcatcaagtatggacatttaagagtgaatcagaccttcaactggaatacacccaagcaagagcattttcctgataacctgctcccatcctaggccattaccttaatctcagcaaatggaatttttgtgatatgctgcctgacctactgctttgccccgagatgcagagagagaaggaggaatgagagattgagaagggaaagtatacaccctgtatga

SEQ ID NO: 165 - DNA, 867 bp, Artificial Sequence
  Description of Artificial Sequence: Synthetic nucleotide sequence
atgggctacacacggaggcagggaatatcaccatccaagtgtccatacctcaagttctttcagctcttggtgctggctggtctttctcatctctgttcaggtgttatccacgtgactaaggaagtgaaagaagtggcaacgctgccctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagatgctttcaagcgggaacacctggctgaagtgatgttatccgtcaaagctgacttccctacacctagtataactgactttgaaattccaccttctaacattagaaggataatttgctcaacctctggaggttttccagagcctcacctcttctggctggaaaatggagaagaattaaatgccatcaacacaacagtttcccaagatcctggaactgagctctatgctgttagcagcaaactggatttcaatatgacaaccaaccacaacttcatgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtatga

SEQ ID NO: 166 - DNA, 867 bp, Artificial Sequence
  Description of Artificial Sequence: Synthetic nucleotide sequence
atgggccacacacggaggcaggggatatcaccatccaagtgtccatacctcaagttctttcagctcttggtgctggctggtctttctcatctctgttcaggtgttatccacatgactaaggaagtgaaagaagtggcaacactgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgctctgaagtatgaaaaagatgctttcaagcaggaacacctggctgaagtgacgttatcagtcaaagctgacttccctacacctagtatatctgactttgaaattccaccttctaacattagaaggataatttgctcaacctctggaggttttccagagcctcgcctcgcctggatggaagatggagaagaattaaatgccatcaacacaacagtttcccaagatcctgaaactgagctctatactgttagcagcaaactggatttcaatatgacagccaaccacagcttcatgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtatgccctgtatga

SEQ ID NO: 167 - DNA, 867 bp, Artificial Sequence
  Description of Artificial Sequence: Synthetic nucleotide sequence
atgggccacacacggaggcagggaatatcaccatccaagtgtccatacctcaagttctttcagctcttggggctggcttgtctttctcatttctgttcaggtgttatccacgtgaccaaggaagtgaaagaagtggcaacactgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcctatctgacgagggcacatacgagtgtgttgttctgaagtatgaaaaggacgctttcaagcgggaacacctggctgaagtgacgttatcagtcaaagctgacttccctacacctagtatatctgactttgaaattccaacttctaacattagaaggataatttgctcaacctctggaggttttccagagcctcacctcttctggctggaaaatggggaagaattaaatgccatcaacacaacagcttcccaagatcctgaaactgagctctatactgttagcagcaaactggatttcaatatgacaaccaatcgcagttttgtgtgtctcatcaagtatggacatttaagagtgaatcagaccttcaactggaatacacccaagcaagagcattttcctgataacctactcccatcctgggccattaccttaatctcagtaaatggaattttcgtgatatgctgcctgacctactgctttgccccaagatgcagagagagaaggaggaatgagagattgagaagggaaagtgtacgccctgtatga

SEQ ID NO: 168 - DNA, 867 bp, Artificial Sequence
  Description of Artificial Sequence: Synthetic nucleotide sequence
atgagccacacacggaggcagggaatatcaccatccaagtgtccatacctcaagttctttcagctcttggtgctggcttgtctttctcatttctgttcaggtgttatccacgtgaccaaggaagtgaaagaagtggcaacgctgtcctgtggtcacaatgtttctgttgaagagctggcacaaactcgcatccactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagatgctttcaagcggaaacacctggctgaagtgatgttatccgtcaaagctgacttccctacacctagtatatctgactttgaaattccaacttctaatattagaaggataatttgctcaacctctggaggttttcctgagcctcacctcttctggctggaaaatggagaagaattaaatgccatcaacacaacagcttcccaagatcctgaaactgagctctatactgttagcagcaaactggatttcaatatgacaaccaatcgcagttttgtgtgtctcatcaagtatggacatttaagagtgaatcagaccttcaactggaatacacccaagcaagagcattttcctaataacctgctcccatcctgggccattaccttaatctcagtaaatggaatttttgtgatatgctgcctgacctactgctttgccccaagatgcagagagaggagaaggaatgagacactgagaagggaaagtgtacaccctgtatga

SEQ ID NO: 169 - DNA, 867 bp, Artificial Sequence
  Description of Artificial Sequence: Synthetic nucleotide sequence
atgggccacacacggaggcagggaacatcaccatccaagtgtccatacctcaagttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagcacaagaaccggaccatctttgatatcactaataacctctccattgtgattctggctctgcgcccatctgacgagggcacatacgagtgtgttgttctgaagtatgaaaaagacgctttcaagcgggaacacctggctgaagtgacgttatcagtcaaagctgacttccctacacctagtataactgactttgaaattccaacttctaatattagaaggataatttgctcaacctctggaggttttccagagcctcacctctcctggctggaaaatggagaagaattaaatgccatcaacacaacagtttcccaagatcctggaactgagctctatactgttagcagcaaactggatttcaatatgacaaccaatcgcagttttgtgtgtctcatcaagtatggacatttaagagtgaatcagaccttcaactggaatacacccaagcaagagcattttcctgataacctgctcccatcctgggccattaccttaatctcagtaaatggaatttttgtgatatgctgcctgacctactgctttgccccaagatgcagggagagaaggaggaatgagagattgagaagggaaagtgtacgccctgtatga

SEQ ID NO: 170 - DNA, 867 bp, Artificial Sequence
  Description of Artificial Sequence: Synthetic nucleotide sequence
atgagccacacacggaggcagggaatatcaccatccaagtgtccatacctcaagttctttcagctcttggtgctggctagtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgcctggggacatgaatatatggcccgagtacaagaaccggaccatctttgatatcactaataacctctccattgtgattctggctctgcgcccatctgacgagggcacatacgagtgtgttgttctgaggtatgaaaaagatgctttcaagcgggaacacctggctgaagtgacgttatcagtcaaagctgacttccctacacctagtatatctgactttgaaattccaacttctaatattagaaggataatttgctcaacctccggaggttttcctgagcctcacctctcctggctggaaaatggggaagaattaaatgccatcaacacaacagcttcccaagatcctgaaactgagctctatactgttagcagcaaactggatttcaatatgacaaccaatcgcagttttgtgtgtctcatcaagtatggacatttaagagtgaatcagaccttcaactggaatacacccaagcaagagcattttcctgataacctgctcccatcctgggccattaccttaatctcagcaaatggaatttttgtgatatgctgcctgacccactgcttcgccccaagatgcagagagagaaagagcaatgagagactgagaagggaaagtgtacgccctgtatag

SEQ ID NO: 171 - DNA, 867 bp, Artificial Sequence
  Description of Artificial Sequence: Synthetic nucleotide sequence
atgagccacacacggaggcagggaatatcaccatccaagtgtccgtacctcaagttctttcagctcttggtgctggctggtctttctcatttctgttcaggtgttatccacgtgactaaggaagtgaaagaagtggcaacactgtcctgtggtcacaatgtttctgttgaagagctggcacaaactcgcatccactggcaaaaggagaagaaaatggtgctgactatgatgtctgggggcatgaatatatggcccgagtacaagaaccggaccatctttgatatcactaataacctctccattgtgattctggctctgcgcccatctgacgagggcacatacgagtgtgttgttctgaagtatgaaaaagacgctttcaagcgggaacacctagctgaagtgacgttatcagtcaaagctgacttccctacacctagtatatctgactttgaaattccaacttctaatattagaaggataatttgctcaacctctggaggttttccagagcctcacctctcctggctggaaaatggagaagaattaaatgccatcagcacaacagtttcccaagatcctggaactgagctctatgctgttagcagcaaactggatttcaatatgacaaccaatcgcagttttgtgtgtctcatcaagtatggacatttaagagtgaatcagaccttcaactggaatacaaccaagcaagagcattttcctgataacctgctcccatcctgggccattaccctaatctcagtaaatggaatttttgtgatatgctgcctgacctactgctttgccccaagatgcagagagagaaggaggaatgagagattgagaagggaaagtgtacgccctgtatag

SEQ ID NO: 172 - DNA, 867 bp, Artificial Sequence
  Description of Artificial Sequence: Synthetic nucleotide sequence
atgggctacacacggaggcagggaacatcaccatccaagtgtccatacctcaagttctttcagctcttggtgctggcttgtctttctcatttctgttcaggtgttatccacgtgactaaggaagtgaaagaagtggcaacactgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctggagtatgaaaaagacgctttcaagcgggaacacctggctgaagtgatgttatccgtcaaagctgacttccctacacctagtatatctgactttgaaattccaccttctaacattagaaggataatttgctcaacctctggaggttttcctgagcctcacctctcctggctggaaaatggagaagaattaaatgccatcaacacaacagtttcccaagatcctggaactgagctctatgctgttagcagcaaactggatttcaatatgacaaccaaccacagcttcatgtgtctcatcaagtatggacatttaagagtgaatcagaccttcaactggaatacacccaagcaagagcattttcctgataacctgctcccatcctgggccattaccctaatctcagtaaatggaatttttgtgatatgctgcctggcctactgctttgccccaagatgcagagggagaaggaggaatgagagattgagaagggaaagtgtacgccctgtatga

SEQ ID NO: 173 - DNA, 867 bp, Artificial Sequence
  Description of Artificial Sequence: Synthetic nucleotide sequence
atgggccacacacggaggcagggaacatcaccatccaagtgtccgtacctcaatttctttcagctcttggtgctggcttgtctttctcacttctgttcaggtgttatccacgtgactaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgattctggctctgcgcccatctgacgagggcacatacgagtgtgttgttctgaagtatgaaaaagatgctttcaagcgagaacacctggctgaagtgatgttatccgtcaaagctgacttccctacacctagtatatctgactttgaaattccaccttctaacattagaaggataatttgctcaacccctggaggttttccagagcctcgcctcgcctggatggaagatggggaagaactaaatgccatcagcacaacagtttcccaagatcctggaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccctaatctcagtaaagggaatttttgtgatatgctgcctgacctactgctttgccccaagatggagagagagaaagagcaatgagagactgagaagggaaagtgtacgccctgtatag

SEQ ID NO: 174 - protein, 303 aa, Artificial Sequence
  Description of Artificial Sequence: Synthetic peptide
  MOD_RES (75): Variable amino acid
MGHTMKWGSLPPKRPCLWLSQLLVLTGLFYFCSGITPKSVTKRVKETVMLSCDYNTSTEELTSLRIYWRKDSKMXLAILPGKVQVWPEYKNRTITDMNDNLRIVILALRLSDSGTYTCVIQKPDLKGAYKLEHLTSVRLMIRADFPVPTINDLGNPSPNIRRLICSTSGGFPRPHLYWLENGEELNATNTTVSQDPGTELYMISSELDFNVTNNHSIVCLIKYGELLVSQIFPWSKPKQEPPIDQLPFWVIIPVSGALVLTAVVLYCLACRHVARWKRTRRNEETVGTERLSPIYLGSAQSSG

SEQ ID NO: 175 - protein, 303 aa, Artificial Sequence
  Description of Artificial Sequence: Synthetic peptide
MGHTMKWGSLPPKCPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLTSVRLMIRADFPVPTINDLGNPSPNIRRLICSTSGGFPRPHLYWLENGEELNATNTTLSQDPETKLYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 176 - protein, 310 aa, Artificial Sequence
  Description of Artificial Sequence: Synthetic peptide
  MOD_RES (310): Variable amino acid
MGHTMKWGSLPPKRPCLWLSQLLVLTGLFYFCSGITPKSVTKRVKETVMLSCDYNTSTEKLTSLRIYWQKDSKMVLAILPGKVQVWPEYKNRTITDMNDNPRIVILALRLSDSGTYTCVIQKPVLKGAYKLEHLTSVRLMIRADFPVPTINDLGNPSPNIRRLICSTSGGFPRPHLYWLENGEELNATNTTVSQDPETKLYMISSELDFNVTNNHSIVCLIKYGELSVSQIFPWSKPKQEPPIDQLPFWVIIPVSGALVLTAVVLYCPACRHVARWKRTRRNEETVGTERLSPIYLGSAQSRAEVPSLSX

SEQ ID NO: 177 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFLVIIPVSGALVLTAVVLYCLACRHVARWKRTRRNEETVGTERLSPIYLGSAQSSG

SEQ ID NO: 178 - protein, 303 aa, Artificial Sequence
  Description of Artificial Sequence: Synthetic peptide
MGHTMKWGSLPPKRPCLWLPQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPRPHLYWLENGEELNATNTTVSQDPETKLYMISSELDFNVTNNHSIVCLIKYGELSVSQIFPWSKPKQEPPIDQLPFRVIIPVSGALVLTAIVLYCLACRHVARWKRTRRNEETVGTERLSPIYLGSAQSSG

SEQ ID NO: 179 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLTSVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 180 - protein, 302 aa, Artificial Sequence
  Description of Artificial Sequence: Synthetic peptide
MGHTMKWGSLPPKRPCLWLSQLLVLTGLFYFCSGITPKSVTKRVKETVMPSCDYSTSTEELTSLRIYWQKDSKMVLAILPGKVQVWPEYKNRTITDMNDNPRIVILALRLSDSGTYTCVVQKNENGSFRREHLTSVTLSIRADFPVPSITDIGHPAPNVKRIRCSASGGFPEPRLAWMEDGEELNAVNTTVDQDLDTELYSVSSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 181 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDKGTYTCVIQKPVLKGAYKLEHLASVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 182 - protein, 296 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLTSVRLMIRADFPVPTINDLGNPSPNIRRLICSTSGGFPRPHLYWLENGEELNATNTTLSQDPETKLYMISSELDFNMTSNHSFLCLVKYGDLTVSQTFYWQESKPTPSANQHLTWTIIIPVSAFGISVIIAVILTCLTCRNAAIRRQRRENEVEMQSCSQSP

SEQ ID NO: 183 - protein, 296 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPDLKGAYKLEHLTSVRLMIRADFPVPTINDLGNPSPNIRRLICSTSGGFPRPHLYWLENGEELNATNTTLSQDPETKLYMISSELDFNMTSNHSFLCLVKYGDLTVSQTFYWQESKPTPSANQHLTWTIIIPVSAFGISVIIAVILTCLTCRNAAIRRQRRENEVKMQSCSQSP

SEQ ID NO: 184 - protein, 275 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDKGTYTCVIQKPVLKGAYKLEHLTSVTLSIRADFPVPSITDIGHPAPNVKRIRCSASGGFPEPRLAWMEDGEELNAVNTTVDQDLDTELYSVSSELDFNATNNHSIVCLIKYGELSVSQIFPWSKPKQEPPIDQLPFWVIVPVSGALVLTAVVLYCLACRHVAR

SEQ ID NO: 185 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDSGTYTCVIQKPVLKGAYKLEHLTSVRLMIRADFPVPTINDLGNPSPNIRRLICSTSGGFPRPHLYWLENGEELNATNTTLSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 186 - protein, 303 aa, Artificial Sequence
  Description of Artificial Sequence: Synthetic peptide
MGHTMKWGSLPPKRPCLWPSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLTSVRLMIRADFPVPTINDLGNPSPNIRRLICSTSGGFPRPHLYWLENGEELNATNTTVSQDPGTELYMISSELDFNVTNNHSIACLIKYGELSVSQIFPWSKPKQEPPIDQLPFWVIIPVSGALVLTAVVLYCLACRHVARWKRTRRNEETVGTERLSPIYLGSAQSSG

SEQ ID NO: 187 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHGARWKRTRRNEETVGTERLSPIYLGSAQSSG

SEQ ID NO: 188 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDSGTYTCVIQKPDLKGAYKLEHLTSVRLMIRADFPVPSITDIGHPAPNVKRIRCSASGDFPEPRLAWMEDGEELNAVNTTVDQDLDTELYSVSSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 189 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPRPHLYWLENGEELNATNTTVSQDPGTELYMISSELGFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 190 - protein, 303 aa, Artificial Sequence
  Description of Artificial Sequence: Synthetic peptide
  MOD_RES (276): Variable amino acid
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARXKRTRRNEETVGTERLSPIYLGSAQSSG

SEQ ID NO: 191 - protein, 293 aa, Artificial Sequence
  Description of Artificial Sequence: Synthetic peptide
MGHTLRPGTPLPRCLHLKLCLLLALAGLHFSSGISQVTKSVKEMAALSCDYNISIDELARMRIYWQKDQQMVLSIISGQVEVWPEYKNRTITDMNDNPRIVILALRLSDSGTYTCVIQKPVLKGAYKPEHLASVRLMIRADFPVPTINDLGNPSPNIRRLICSTSGGFPRPHLYWLENGEELNATNTTLSQDPETKLYMISSELDFNMTSNHSFLCLVKYGDLTVSQTFYWQESKPTPSANQHLTWTIIIPVSAFGISVIIAVILTCLTCRNAAIRRQRRENEVEMQSCSQSP

SEQ ID NO: 192 - protein, 301 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVIQALRLSDSGTYTCVIQKPVLKGAYKLEHLASVRLMIRADFPVPTDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 193 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLTSVRLMIRADFPVPTINDLGNPSPNIRRLICSTSGGFPRPHLYWLENGEELNATNTTLSQDPETELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 194 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDSGTYTCVIQKPVLKGAYKLEHLTSVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 195 - protein, 302 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVVQKNENGSFRREHLTSVTLSIRADFPVPSITDIGHPAPNVKRIRCSASGDFPEPRLAWMEDGEELNAVNTTVDQDLDTELYSVSSELDFNVTNNHSIVCLIKYGELSVSQIFPWSKPKQEPPIDQLPFWVIILVSGALVLTAVVLYCLACRHVARWKRTRRNEETVGTERLSPIYLGSAQSSG

SEQ ID NO: 196 - protein, 300 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDSGTYTCVIQKPVLKGAYKLEHLASVRLMIRADFPVPSITDIGHPAPNVKRIRCSASGDFPEPRLAWMEDGEELNAVNTTVLDTELYSVSSELDFNVTNNHSIVCLIKYGELSVSQIFPWSKPKQEPPIDQLPFWVIIPVSGALVLTAVVLYCLACRHVARWKRTRRNEETVGTERLSPIYLGSAQPSG

SEQ ID NO: 197 - protein, 303 aa, Artificial Sequence
  Description of Artificial Sequence: Synthetic peptide
MGHTMEWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPRPHLYWLENGEELNATNTTLSQDPETELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 198 - protein, 303 aa, Artificial Sequence; identical to SEQ ID NO: 64
  Description of Artificial Sequence: Synthetic peptide

SEQ ID NO: 199 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPRPHLYWLENGEELNATNTTLSQDPETKLYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 200 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPDLKGAYKLEHLTSVRLMIRADFPVPSITDIGHPAPNVKRIRCSASGDFPEPRLAWMEDGEELNAVNTTVDQDLDTELYSVSSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 201 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPDLKGAYKLEHLASVRLMIRADFPVPSITDIGHPAPNVKRIRCSASGDFPEPRLAWMEDGEELNAVNTTVDQDLDTELYSVSSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 202 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLASVRLMIRADFPVPSINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 203 - protein, 302 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTFPDIINNLSLMILALRLSDKGTYTCVVQKNENGSFRREHLTSVTLSIRADFPVSSITDIGHPAPNVKRIRCSASGGFPEPRLAWMEDGEELNAVNTTVDQDLDTELYSVSSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 204 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLTSVRLMIRADFPVPSITDIGHPAPNVKRIRCSASGGFPEPRLAWMEDGEELNAVNTTVDQDLDTELYSVSSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 205 - protein, 303 aa, Artificial Sequence
  Description of Artificial Sequence: Synthetic peptide
MGHTMKWGSLPPKRPCLWLSQLLVLTDLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 206 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPRPHLYWLENGEELNATNTTLSQDPETKLYMISSELDFNVTNNHSIVCLIKYGELSVSQIFPWSKPKQEPPIDQLPFWVIIPVSGALVLTAAVLYCLACRHVARWKRTRRNEETVGTERLSPIYLGSAQSSG

SEQ ID NO: 207 - protein, 300 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 208 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDKGTYTCVIQKPVLKGAYKLEHLASVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 209 - protein, 303 aa, Artificial Sequence; identical to SEQ ID NO: 52
  Description of Artificial Sequence: Synthetic peptide

SEQ ID NO: 210 - protein, 304 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPDLKGAYKLEHLASVRLMIRADFPVPSITDIGHPAPNVKRIRCSASGGFPEPRLAWMEDGEELNAVNTTVDQDLDTELYSVSSELDFNMTSNHSFLCLVKYGDLTVSQTFYWQESKPTPSANQHLTWTIIIPVSAFGISVIIAVILTCLTCRNAAIRRQRRENEGKCKVLSVSIGTKLKFNR

SEQ ID NO: 211 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDKGTYTCVVQKPDLKGAYKLEHLASVRLMIRADFPVPSITDIGHPAPNVKRIRCSASGGFPEPRLAWMEDGEELNAVNTTVDQDLDTELYSVSSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 212 - protein, 296 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDSGTYTCVIQKPVLKGAYKLEHLTSVRLMIRADFPVPTINDLGNPSPNIRRLICSTSGGFPRPHLYWLENGEELNATNTTLSQDPETKLYMISSELDFNMTSNHSFLCLVKYGDLTVSQSFYWQESKPTPSANQHLTWTIIIPVSAFGISVIIAVILTCLTCRNAAIRRQRRENEVEMQSCSQSP

SEQ ID NO: 213 - protein, 302 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDKGTYTCVVQKNENGSFRREHLTSVTLSIRADFPVPSITDIGHPAPNVKRIRCSASGGFPEPRLAWMEDGEELNAVNTTVDQDLDTELYSVSSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 214 - protein, 296 aa, Artificial Sequence
  Description of Artificial Sequence: Synthetic peptide
MGHTMKWGSLPPKRPCLWLSQLLVLTGLFYFCSGTTPKSVTKRVKETVMLSCDYNTSTEELTSLRIYWQKDSKMVLAILPGKVQVWPEYKNRTITDMNDNPRIVILALRPSDSGTYTCVIQKPVLKGAYKLEHLASVRLMIRADFPVPTINDLGNPSPNIRRLICSTSGGFPRPHLYWLENGEELNATNTTLSQDPETKLYMISSELDFNMTSNHSFLCLVKYGDLTVSQTFYWQESKPTPSANQHLTWTIIIPVSAFGISVIIAVILTCLTCRNAAIRRQRRENEVEMQSCSQSP

SEQ ID NO: 215 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPDLKGAYKLEHLASVRLMIRADFPVPTINDLGNPSPNIRRLICSTSGGFPRPHLYWLENGEELNATNTTLSQDPETKLYMISSELDFNVTNNRSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 216 - protein, 296 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLTSVRLMIRADFPVPTINDLGNPSPNIRRLICSTSGGFPRPHLYWLENGEELNATNTTVSQDPETKLYMISSELDFNTTSNHSFLCLVKYGDLTVSQTFYWQESKPTPSANQHLTWTIIIPVSAFGISVIIAVILTCLTCRNAAIRRQRRENEVEMQSCSQSP

SEQ ID NO: 217 - protein, 303 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDKGTYTCVIQKPDLKGAYKLEHLASVRLMIRADFPVPTINDLGNPSPNIRRLICSTSGGFPRPHLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 218 - protein, 296 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPDLKGAYKLEHLTSVRLMIRADFPVPTINDLGNPSPNIRRLICSTSGGFPRPHLYWLENGKELNATNTTLSQDPETKLYMISSELDFNMTSNHSFLCLVKYGDLTVSQTFYWQESKPTPSANQHLTWTIIIPVSAFGISVIIAVILTCLTCRNAAIRRQRRENEVEMQSCSQSP

SEQ ID NO: 219 - protein, 302 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVVQKNENGSFRREHLTSVTLSIRADFPVPSITDIGHPAPNVKRIRCSASGGFPEPRLAWMEDGEELNAVNTTVDQDLDTELYSVSSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 220 - protein, 303 aa, Artificial Sequence
  Description of Artificial Sequence: Synthetic peptide
MGHTMKWGSLPPKRPCLRLSQLLVLTGLFYFCSGITPKSVTKRVKETVMLSCDYSTSTEELTSLRIYWQKDSKMVLAILPGKVQVWPEYKNRTITDMNDNPRIVILALRLSDSGTYTCVIQKPDLKGAYKLEHLTSVRLMIRADFPVPTINDLGNPSPNIRRLICSTSGGFPRPHLYWLENGEELNATNTTLSQDPETKLYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 221 - protein, 293 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLTSVRLMIRADFPVPTINDLGNPSPNIRRLICSTSGGFPRPHLYWLENGEELNATNTTLSQDPETKLYMISSELDFNMTSNLCLVKYGDLTVSQTFYWQESKPTPSANQHLTWTIIIPVSAFGISVIIAVILTCLTCRNAAIRRQRRENEVEMQSCSQSP

SEQ ID NO: 222 - protein, 288 aa, Artificial Sequence
  Description of Artificial Sequence: Synthetic peptide
MSHTRRQGTSPSKCPYLKFFQFLVLASLSHFCSGVIHVTKEVKEVATLSCGLNVSVEELAQTRIYWQKGKKMVLTMMSGDMNIWPEYKNRTIFDITNNLSIVILALRPSDEGTYECVVLEYEKDAFKREHLAEVMLSVKADFPTPSISDFEIPPSNIRRIICSTSGGFPEPHLSWLENGEELNAINTTASQDPGTELYTVSSKLDFNMTTNHSFMCLIKYGHLRVNQTFNWNTPKQEHFPDNLLPSWAITLISVNGIFVICCLTHCFAPRCRERRRNERLRRESARPV

SEQ ID NO: 223 - protein, 288 aa, Artificial Sequence
  Description of Artificial Sequence: Synthetic peptide
MGYTRRQGTSPSKCPYLKFFQLLVLASLSHFCSGVIHVTKEVKEVATLSCGHNVSVEELAQTPIYWQKEKKMVLTMMSGDMNIWPEYKNRTIFDITNNLSIVILALRPSDEGTYECVVLKYEKDAFKREHLAEVMLSVKADFPTPSITDFEIPPSNIRRIICSTSGGFPEPHLFWLENGEELNAINTTVSQDPETELYTVSSKLDFNMTTNRSFVCLIKYGHLRVNQTFNWNTPKQEHFPDNLLPSWAITLISANGIFVICCLTYRFAPRCRERRRNERLRRESVCPV

SEQ ID NO: 224 - protein, 288 aa, Artificial Sequence
  Description of Artificial Sequence: Synthetic peptide
MGYTRRQGISPSKCPYLKFFQLLVLASLSHFCSGVIHVTKKVKEVATLSCGHNVSVEELAQTRIHWQKEKKMVLTMMSGDMNIWPEYKNRTIFDITNNLSIVILALRPSDEGTYECVVLKYEKDAFKREHLAEVMLSVKADFPTPSISDFEIPPSNIRRIICSTSGGFPEPHLSWLENGEELNAINTTVSQDPGTELYTVSSKLDFNMTTDRSFVCLIKYGHLRVNQTFNWNTPKQEHFPDNLLPSWAITLISVNGIFVICCLTYCFAPRCRERRRNGRLRRESVRPV

SEQ ID NO: 225 - protein, 288 aa, Artificial Sequence
  Description of Artificial Sequence: Synthetic peptide
MSHTQRQGISPSKCPYLNFFQLLVLASLSHFCSGVIHVTKEVKEVATLSCGHNVSVEELAQTRIYWQKEKKMVLTMMSGDMNIWPEYKNRTIFDITNNLSIVILALRPSDEGTYECVVLEYEKDAFKREHLAEVTLSVKADFPTPSITDFEIPPSNIRRIICSTSGGFPEPHLFWLENGEELNAISTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVHPV

SEQ ID NO: 226 - protein, 288 aa, Artificial Sequence
  Description of Artificial Sequence: Synthetic peptide
MGHTRRQGTSPSKCPYLKFFQLLVLAGLSHLCSGVIHVTKEVKEVATLSCGHNVSVEELAQTRIYWQKEKKMVLTMMSGDMNIWPEYKNRTIFDITNNLSIVILALRPSDEGTYECVVLEYEKDAFKREHLAEVTLSVKADFPTPSISDFEIPTSNIRRIICSTSGGFPEPHLFWLENGEELNAINTTVSQDPETELYTVSSKLDFNMTANHSFVCLIKYGHLRVNQTFNWNTPKQEHFPDNLLPSWAITLISVNGIFVICCLTYCFAPGCRERRRNERLRRESVCPV

SEQ ID NO: 227 - protein, 288 aa, Artificial Sequence
  Description of Artificial Sequence: Synthetic peptide
MSHIRRQGISPSKCPYLNFFQLLVLACLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPPSNIRRIICSTSGGFPEPRLAWMEDGEELNAINTTASQDPETELYTVSSKLDFNMTTNRSFVCLIKYGHLRVNQTFNWNTPKQEHFPDNLFPSWAITLISVNGIFVICCLTYCFAPRCRERRRNERLRRESVRPV

SEQ ID NO: 228 - protein, 288 aa, Artificial Sequence
  Description of Artificial Sequence: Synthetic peptide
MSHTRRQGTSPSKCPYLKFFQLLVLASLSHFCSGVIHMTKEVKEVATLSCGPNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPGTELYTVSSKLDFNMTTNHSFMCLIKYGHLRVNQTFNWNTPKQEHFPDNLLPSWAITLISVNGIFVICCLTHCFAPRCRERRRNERLRRESVCPV

SEQ ID NO: 229 - protein, 288 aa, Artificial Sequence
  Description of Artificial Sequence: Synthetic peptide
MSHTRRQGISSSKCPYLKFFQLLVLACLSHFCSGVIHVTKKVKEVATLSCGHNVSVEELAQTRIYWQKGKKMVLTMMSGDMNIWPECKNRTIFDITNNLSIVILALRPSDEGTYECAVLKYEKDAFKREHLAEVTLSVKADFPTPSISDFEIPTSNIRRIICSTSGGFPEPHLFWLENGEELNAINTTASQDPETELYAVSSKLDFNMTTNHSFMCLIKYGHLRVNQTFNWNTPKQEHFPDNLLPSWAITLISVNGIFVICCLTYCFAPRCRERKSNERLRRESVRPV

SEQ ID NO: 230 - protein, 288 aa, Artificial Sequence
  Description of Artificial Sequence: Synthetic peptide
MGYTRRQGTSPSECPYLKFFQLLVLAGLSHFCSGVIHMTKEVKEVATLSCGLNVSVEELAQTRIHWQKEKKMVLTMMSGDMNIWPEYKNRTIFDITNNLSIVILALRPSDEGTYECVVLKYEKDAFKREHLAEVMLSVKADFPTPSISDFEIPPSNIRRIICSTSGGFPEPHLSWLENGEELNAINTTVSQDPETGLYTVSSKLDFNMTTNHSFMCLIKYGHLRVNQTFNWNTPKQEHFPDNLLPSWAITLISVNGIFVICCLTYCFAPRCRERRRNERLRRESVRPV

SEQ ID NO: 231 - protein, 288 aa, Artificial Sequence
  Description of Artificial Sequence: Synthetic peptide
MSHTRRQGISPSKCPYLNFFRLLVLASLSHFCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVTLSVKADFPTPSITDFEIPPSNIRRIICSTSGGFPEPHLSWLENGEELNAINTTVSQDPGTELYTVSSKLDFNMTANHSFVCLIKYGHLRVNQTFNWNTPKQEHFPDNLLPSWAITLISANGIFVICCLTYCFAPRCRERRRNERLRRESVRPV

SEQ ID NO: 232 - protein, 300 aa, Artificial Sequence
  Description of Artificial Sequence: Synthetic peptide
  MOD_RES (298): Variable amino acid
MSHTRRQGISPSKCPYLKFFQLLVLASLSHFCSGVIHVTKEVKEVATLSCGHNVSVEELAQTRIYWQKEKKMVLTMMSGDMNIWPEHKNRTIFDITNNLSIVILALRPSDEGTYECVVLKYEKDAFKREHLAEVMLSVKADFPTPSISDFEIPPSNIRRIICSTSGGFPEPHLSWLENGEELNAINTTVSQDPETELYTGSSKLDFNMTTNHSFMCLIKYGHLRVNQTFSWNTPKQEHFPDNLLPSWAITLISANGIFVICCLTYCFAPRCRERRRNETLRRESVRPVWGTKLKFKPXIS

SEQ ID NO: 233 - protein, 288 aa, Artificial Sequence
  Description of Artificial Sequence: Synthetic peptide
MGHTRRQGISPSKCPYLKFFQLLVLASLSHFCSGVIHVTKEVKEVATLSCGLNVSVEELAQTRIYWQKEKKMVLTMMSGDMNIWPEHKNRTIFDITNNLSIVILALRPSDEGTYECVVLKYEKDAFKREHLAEVTLSVKADFPTPSITDFEIPPSNIRRIICSTSGGFPEPHLFWLENGEELNAINTTASQDPETELYTVSSKLDFNMTANHSFVCLIKYGHLRVNQTFNWNTPKQEHFPDNLLPSWAITLISVNGIFVICCLTYCFAPRCRERRRNETLRRESVRPV

SEQ ID NO: 234 - protein, 288 aa, Artificial Sequence
  Description of Artificial Sequence: Synthetic peptide
MGYTRRQGTSPSKCPYLNFFQLLVLASLSHFCSGVIHVTKEVKEVATLSCGHNVPVEELAQTRIYWQKEKKMVLTMMSGDMNIWPEYKNRTIFDITNNLSIVILALRPSDEGTYGCVVLEYEKDAFKREHLAEVMLSVKADFPTPSITDLEIPPSNIRRIICSTSGGFPEPHLFWLENGEELNAINTTASQDPETELYAVSSKLDFNMTTNHSFMCLIKYGHLRVNQTFNWNTPKQEHFPDNLLPSWAITLISANGIFVICCLTYCFAPRCRERRRNERLRRESVHPV

SEQ ID NO: 235 - protein, 288 aa, Artificial Sequence
  Description of Artificial Sequence: Synthetic peptide
MGHTRRQGISPSKCPYLKFFQLLVLACLSHFCSGVIHVTKEVKEVATLSCGHNVSVEELAQTRIYWQKDKKMVLTMMSGDMNIWPEYKNQTIFDITNNLSIVILALRPSDEGTYECVVLKYEKDAFKQEHLAEVMLSVKADFPTPSISDFEIPPSNIRRIICSTSGGFPEPRLAWMEDGEELNAISTTVSQDPGTELCTVSSKLDFNMTTNHSFMCLIRYGHLRVNQTFNWNTPKQEHFPDNLLPSWAITLISVKGIFVICCLTYCFAPRGRERKSNGRLRRESVHPV

SEQ ID NO: 236 - protein, 288 aa, Artificial Sequence
  Description of Artificial Sequence: Synthetic peptide
  MOD_RES (200): Variable amino acid
MGHTRRQGTSPSKCPYLKFFQLLVLAGLSHFCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVMLSVKADFPTPSISDFEIPPSNIRRIICSTSGGFPEPHLFWLENGEELNAISTTVSQDPETELYAXSSKLDFNMTTNHSFMCLIKYGHLRVNQTFNWNTPKQEHFPDNLLPSWAITLISVNGIFVICCPTYCFAPRCRERRRNERLRRESVCPV

SEQ ID NO: 237 - protein, 287 aa, Artificial Sequence
  Description of Artificial Sequence: Synthetic peptide
MGHTRRQGISPSKCPYLKFFQLLVLACLSHFCSGVIYVTKEVKEVATLSCGHNVSVEELAQTRIYWQKEKKMVLIMMSGDMNIWPEYKNRTIFDITNNLSIVILALRPSDEGTECVVLKYEKDAFKREHLAEVTLSVKADFPTPSISDFEIPPSNIRRIICSTSGGFPEPHLSWLENGEELNAINTTVSQDPGTELYTVSSKLDFNMTTNHSFMCLIKYGHLRVNQTFNWNTPKQEHFPDNLLPSWAITLISVNGIFVICCLTYCFAPRCRERRRNERLRRESVCPV

SEQ ID NO: 238 - protein, 288 aa, Artificial Sequence
  Description of Artificial Sequence: Synthetic peptide
MGHTRRQGTSPSKCPYLKFFQLLVLAGLSHFCSGVIHVTKEVKEVATLSCGHNVSVEELAQTRIHWQKEKKMVLTMMSGDMNIWPEYKNRTIFDITNNLSIVILALRPSDEGTYGCVVLEYEKDAFKREHLAEVMLSVKADFPTPSISDFEIPPSNIRRIICSTSGGFPEPHLSWLENGEELNAINTTVSQDPETELYAVSSKLDFNMTTNHSFMCLIKYGHLRANQTFNWNTPKQEHFPDNLLPSWAITLISVNGIFVICCLTYCFAPRCRERRRNERLRRESVRPV

SEQ ID NO: 239 - protein, 288 aa, Artificial Sequence
  Description of Artificial Sequence: Synthetic peptide
MGYTRRQGTSPSKCPYLNFFQLLVLASLSHFCSGVIHVTKEVKEVATLSCGHNVSVEELAQTRIHWQKEKKMVLTMMSGDMNIWPEYKNRTIFDITNNLSVVILALRPSDEGTYECVVLKYEKDAFKREHLAEVTLSVKADFPTPSITDFEIPPSNIRRIICSTSGGFPEPHLSWLENGEELNAINTTVSQDPGTELYTVSSKLDFNMTTNRSFVCLIKYGHLRVNQTFNWNTPKQEHFPDNLLPSWAITLISVNGIFVICCLTYCFAPRCRERKSNERLRRESVRPV

SEQ ID NO: 240 - protein, 288 aa, Artificial Sequence
  Description of Artificial Sequence: Synthetic peptide
MGYTRRQGISPSKCPYLKFFQLLVLAGLSHFCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVMLSVKADFPTPSITDFEIPPSNIRRIICSTSGGFPEPRLAWMEDGEELNAINTTVSQDPGTELYAVSSKLDFNMTTNHSFMCLIKYGHLRVNQTFNWNTPKQEHFPDNLLPSWAITLISVNGISVICCLTYCFAPRCRERRRNERLRRESVCPV

SEQ ID NO: 241 - protein, 288 aa, Artificial Sequence
  Description of Artificial Sequence: Synthetic peptide
MSHTRRQGISPSKCPYLKFFQLLVLAGLSHFCSGVIHVTKEVKEVATLSCGHNVSAEELAQTRIYWQKEKKMVLTMMSGDMNIWPEYKNRTIFDITNNLSIVILALRPSDEGTYECVVLEYEKDAFKREHLAEVMLSVKADFPTPSITDFEIPTSNIRRIICSTSGGFPEPRLAWMEDGEELNAISTTASQDPETELYTVSSKLDFNMTTNHSFMCLIKYGHLRVNQTFNWNTPKQEHFPDNLLPSWAITLISVNGIFVICCLTHCFAPRCRERRRNERLRRESVCPV

SEQ ID NO: 242 - protein, 288 aa, Artificial Sequence
  Description of Artificial Sequence: Synthetic peptide
MGHTRRQGISPSKCPYLKFFQLLVLAGLSHFCSGVIHVTKEVKEVATLSCGLNVSVEELAQTRIHWQKEKKMVLTMMSGDMNIWPEYKNRTIFDITNNLSIVILALRPSDEGTYECVVLKYEKDAFKREHLAEVMLSVKADFPTPSITDFEIPPSNIRRIICSTSGGFPEPHLSWLENGEELNAINTTVSQDPGTELYTVSSKLDFNMTTNHSFMCLIKYGHLRVNQTFNWNTPKQEHFPDNLLPSWAITLISANGIFVICCLTYCFAPRCRERKSNERLRRESVCPV

SEQ ID NO: 243 - protein, 287 aa, Artificial Sequence
  Description of Artificial Sequence: Synthetic peptide
MGYTRRQGISPSKCPYLKFFQLLVLACLSHFCSGVIHVTKEVKEVATLSCGHNVSDEELAQTRIHWQKEKKMVLTMMSGDMNIWPEYKNRTIFDITNNLSIVILALRPSDEGTYECVVLKYEKDAFKREHLAEVTLSVKADFPTPSISDFEIPPSNIRRIICSTSGGFPEPHLSWLENGEELNAINTTVSQDPGTELYTVSSKLDFNMTTNHSFMCLIKYGHLRVNQTFNWNTPKQEHFPDNLLPSAITLISANGIFVICCLTYCFAPRCRERRRNERLRRESIHPV

SEQ ID NO: 244 - protein, 288 aa, Artificial Sequence
  Description of Artificial Sequence: Synthetic peptide
MGYTRRQGISPSKCPYLKFFQLLVLAGLSHLCSGVIHVTKEVKEVATLPCGHNVSVEELAQTRIHWQKEKKMVLTMMSGDMNIWPEYKNRTIFDITNNLSIVILALRPSDEGTYECVVLKYEKDAFKREHLAEVMLSVKADFPTPSITDFEIPPSNIRRIICSTSGGFPEPHLFWLENGEELNAINTTVSQDPGTELYAVSSKLDFNMTTNHNFMCLIKYGHLRVNQTFNWNTPKQEHFPDNLLPSWAITLISVNGIFVICCLTYCFAPRCRERRRNERLRRESVRPV

SEQ ID NO: 245 - protein, 288 aa, Artificial Sequence
  Description of Artificial Sequence: Synthetic peptide
MGHTRRQGISPSKCPYLKFFQLLVLAGLSHLCSGVIHMTKEVKEVATLSCGHNVSVEELAQTRIYWQKEKKMVLTMMSGDMNIWPEYKNRTIFDITNNLSIVILALRPSDEGTYECVALKYEKDAFKQEHLAEVTLSVKADFPTPSISDFEIPPSNIRRIICSTSGGFPEPRLAWMEDGEELNAINTTVSQDPETELYTVSSKLDFNMTANHSFMCLIKYGHLRVNQTFNWNTPKQEHFPDNLLPSWAITLISVNGIFVICCLTYCFAPRCRERRRNERLRRESVCPV

SEQ ID NO: 246 - protein, 288 aa, Artificial Sequence
  Description of Artificial Sequence: Synthetic peptide
MGHTRRQGISPSKCPYLKFFQLLGLACLSHFCSGVIHVTKEVKEVATLSCGHNVSVEELAQTRIHWQKEKKMVLTMMSGDMNIWPEYKNRTIFDITNNLSIVILALRLSDEGTYECVVLKYEKDAFKREHLAEVTLSVKADFPTPSISDFEIPTSNIRRIICSTSGGFPEPHLFWLENGEELNAINTTASQDPETELYTVSSKLDFNMTTNRSFVCLIKYGHLRVNQTFNWNTPKQEHFPDNLLPSWAITLISVNGIFVICCLTYCFAPRCRERRRNERLRRESVRPV

SEQ ID NO: 247 - protein, 288 aa, Artificial Sequence
  Description of Artificial Sequence: Synthetic peptide
MSHTRRQGISPSKCPYLKFFQLLVLACLSHFCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKRKHLAEVMLSVKADFPTPSISDFEIPTSNIRRIICSTSGGFPEPHLFWLENGEELNAINTTASQDPETELYTVSSKLDFNMTTNRSFVCLIKYGHLRVNQTFNWNTPKQEHFPNNLLPSWAITLISVNGIFVICCLTYCFAPRCRERRRNETLRRESVHPV

SEQ ID NO: 248 - protein, 288 aa, Artificial Sequence
  Description of Artificial Sequence: Synthetic peptide
MGHTRRQGTSPSKCPYLKFFQLLVLAGLSHFCSGVIHVTKEVKEVATLSCGHNVSVEELAQTRIYWQKEKKMVLTMMSGDMNIWPEHKNRTIFDITNNLSIVILALRPSDEGTYECVVLKYEKDAFKREHLAEVTLSVKADFPTPSITDFEIPTSNIRRIICSTSGGFPEPHLSWLENGEELNAINTTVSQDPGTELYTVSSKLDFNMTTNRSFVCLIKYGHLRVNQTFNWNTPKQEHFPDNLLPSWAITLISVNGIFVICCLTYCFAPRCRERRRNERLRRESVRPV

SEQ ID NO: 249 - protein, 288 aa, Artificial Sequence
  Description of Artificial Sequence: Synthetic peptide
MSHTRRQGISPSKCPYLKFFQLLVLASLSHFCSGVIHVTKEVKEVATLSCGHNVSVEELAQTRIYWQKEKKMVLTMMPGDMNIWPEYKNRTIFDITNNLSIVILALRPSDEGTYECVVLRYEKDAFKREHLAEVTLSVKADFPTPSISDFEIPTSNIRRIICSTSGGFPEPHLSWLENGEELNAINTTASQDPETELYTVSSKLDFNMTTNRSFVCLIKYGHLRVNQTFNWNTPKQEHFPDNLLPSWAITLISANGIFVICCLTHCFAPRCRERKSNERLRRESVRPV

SEQ ID NO: 250 - protein, 288 aa, Artificial Sequence
  Description of Artificial Sequence: Synthetic peptide
MSHTRRQGISPSKCPYLKFFQLLVLAGLSHFCSGVIHVTKEVKEVATLSCGHNVSVEELAQTRIHWQKEKKMVLTMMSGGMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAISTTVSQDPGTELYAVSSKLDFNMTTNRSFVCLIKYGHLRVNQTFNWNTTKQEHFPDNLLPSWAITLISVNGIFVICCLTYCFAPRCRERRRNERLRRESVRPV

SEQ ID NO: 251 - protein, 288 aa, Artificial Sequence
  Description of Artificial Sequence: Synthetic peptide
MGYTRRQGTSPSKCPYLKFFQLLVLACLSHFCSGVIHVTKEVKEVATLSCGHNVSVEELAQTRIYWQKEKKMVLTMMSGDMNIWPEYKNRTIFDITNNLSIVILALRPSDEGTYECVVLEYEKDAFKREHLAEVMLSVKADFPTPSISDFEIPPSNIRRIICSTSGGFPEPHLSWLENGEELNAINTTVSQDPGTELYAVSSKLDFNMTTNHSFMCLIKYGHLRVNQTFNWNTPKQEHFPDNLLPSWAITLISVNGIFVICCLAYCFAPRCRGRRRNERLRRESVRPV

SEQ ID NO: 252 - protein, 288 aa, Artificial Sequence
  Description of Artificial Sequence: Synthetic peptide
MGHTRRQGTSPSKCPYLNFFQLLVLACLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVMLSVKADFPTPSISDFEIPPSNIRRIICSTPGGFPEPRLAWMEDGEELNAISTTVSQDPGTELYAVSSKLDFNMTTNHSFMCLIKYGHLRVNQTFNWNTTKQEHFPDNLLPSWAITLISVKGIFVICCLTYCFAPRWRERKSNERLRRESVRPV

SEQ ID NO: 253 - DNA, 880 bp, Artificial Sequence
  Description of Artificial Sequence: Synthetic nucleotide sequence
atgggccacacgctgaggccgggaactccactgcccaggtgtctacacctcaagctctgcctgctcttggcgctggcgggtctccacttctcttcaggtatcagccaggtcaccaagtcggtgaaagaaatggcagcactgtcctgtgattacaacatttctatcgatgaactggcgagaatgcgcatatactggcagaaggaccaacagatggtgctgagcatcatctctgggcaagtggaagtgtggcctgagtacaaaaaccgcaccttccccgacatcattaacaacctctcccttatgatcctggcactgcgcctgtcggacaagggcacctacacctgcgtggttcagaagaatgagaacgggtctttcagacgggagcacctgacctccgtgacactgtccatcagagctgacttccctgtccctagcataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaacatgacaagcaatcacagcttcttgtgtcttgtcaagtatggagacttaacagtgtcacagaccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtggaaatgcaaagttgctctcagtctccatgag

SEQ ID NO: 254 - DNA, 891 bp, Artificial Sequence
  Description of Artificial Sequence: Synthetic nucleotide sequence
atgggtcacacaatggagtggggatcactaccacccaagcgcccatgcctctggctctctcagctcttggtgctcactggtcttttttacttctgttcaggcatcaccccaaagagtgcgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgatttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaacatgacaagcaatcacagcttcttgtgtcttgtcaagtatggagacttaacagtgtcacagaccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtggaaatgcaaagttgctctcagtctccatag

SEQ ID NO: 255 - DNA, 889 bp, Artificial Sequence
  Description of Artificial Sequence: Synthetic nucleotide sequence
atgggccacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgcgtggttcagaagaatgagaacgggtctttcagacgggagcacctgacctccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgccccaagatcctgaaaccaagctctacatgattagcagtgaactggatttcaacatgacaagcaatcacagcttcttgtgtcttgtcaagtatggagacttaacagtgtcacagaccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtggaaatgcaaagttgctctcagtctccatgag

SEQ ID NO: 256 - DNA, 888 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacaagggcacctacacctgcgtggttcagaagaatgagaacgggtctttcagacgggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaacatgacaagcaatcacagcttcttgtgtcttgtcaagtatggagacttaacagtgtcgcagaccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtggagatgcaaagttgctctcagtctccatag

SEQ ID NO: 257 - DNA, 891 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacagtggcacctacacctgtgttattcagaagcctgatttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaacatgacaagcaatcacagcttcttgtgtcttgtcaagtatggagacttaacagtgtcacagaccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtggaaatgcaaagttgctctcagtctccatga

SEQ ID NO: 258 - DNA, 910 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacaagggcacctacacctgcgtggttcagaagaatgagaacgggtctttcagacgggagcacctgacctccgtgacactgtccatcagagctgacttccctgtccctagcataactgacattggacatcccgcccctaatgtgaaaaggataagatgctccgcctctggaggttttccagagcctcgcctctactggttggaaaatggagaagaattaaatgctaccaacacaacagtttcccaagatcctggaactgagctctacatgattagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctgag

SEQ ID NO: 259 - DNA, 888 bp, Artificial Sequence
  Description of Artificial Sequence: Synthetic nucleotide sequence
atggatcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacaagggcacctacacctgcgtggttcagaagaatgagaacgggtctttcagacgggagcacctgacctccgtgacactgtccatcagagctgactttcctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaacatgacaagcaatcacagcttcttgtgtcttgtcaagtatggagacttaacagtgtcacagaccttctactggcaagaatccaaaccaaccccttctgctaatcagcacctgacctggaccattattatcccggtctcagcatttgggatttctgtgatcattgcagttatactaacatgcctgacctgcagaaatgctgcaatacgcagacagagaagggagaatgaagtggaaatgcaaagttgctctcagtctccatag

SEQ ID NO: 260 - DNA, 888 bp, Artificial Sequence
  Description of Artificial Sequence: Synthetic nucleotide sequence
atgggtcacacaatgaagtggggatcactaccacccaagcgcccatgcctctggctctctcagctcttggtgcccactggtcttttttacttctgttcaggtatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcgcctgtcggacaagggcacctacacctgcgtggttcagaagaatgagaacgggtctttcagacgggagcacctgacctccgtgacactgtccatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaacatgacaagcaatcacagcttcttgtgtcttgtcaagtatggagacttaacagtgtcacagaccctctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtggaaatgcaaagttgctctcagtctccatga

SEQ ID NO: 261 - DNA, 891 bp, Artificial Sequence
  Description of Artificial Sequence: Synthetic nucleotide sequence
atgggtcacacagtgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgagtacaagaaccgcaccatcactgacatgaacgataacccccgtattgtgatcctggctctgcccctgtcggacagtggcacctacacctgtgttattcagaagcctgatttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaacatgacaagcaatcacagcttcttgtgtcttgtcaagtatggagacttaacagtgtcacagaccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtggaaatgcaaagttgctctcagtctccatga

SEQ ID NO: 262 - DNA, 910 bp, Artificial Sequence
  Description of Artificial Sequence: Synthetic nucleotide sequence
atgggtcacacaatgaagtggggatcactaccacccaagcgcccatgcctctggctctctcagctcttggtgctcactggtcttttttacttctgttcaggcatcaccccaaagagtgtgaccaaaagagtgaaagaaacagtaatgctatcctgtgattacagcacatccactgaagaactgacaagccttcggatctattggcaaaaggatagtaaaatggtgctggccatcctgcctggaaaagtgcaggtgtggcctgagtacaaaaaccgcaccttccccgacatcattaacaacctctcccttatgatcctggcactgcgcctgtcggacaggggcacctacacctgcgtggttcagaagaatgagaacgggtctttcagacgggagcacctgacctccgtgacactgtccatcagagctgacttccctgtccctagcataactgacattggacatcccgcccctaatgtgaaaaggataagatgctccgcctctggaggttttccagagcctcgcctcgcctggatggaagatggagaagaactaaacgccgtcaacacgacggttgaccaggatttggacacggagctctacagcgtcggcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcccgcagacatgttgcgaggtggaaaagaacaagaaggaatgaagagacagtgggaactgaaaggctgtcccctatctacttaggctctgcgcaatcctcgggctgag

SEQ ID NO: 263 - protein, 292 aa, Artificial Sequence
  Description of Artificial Sequence: Synthetic peptide
MGHTLRPGTPLPRCLHLKLCLLLALAGLHFSSGISQVTKSVKEMAALSCDYNISIDELARMRIYWQKDQQMVLSIISGQVEVWPEYKNRTFPDIINNLSLMILALRLSDKGTYTCVVQKNENGSFRREHLTSVTLSIRADFPVPSINDLGNPSPNIRRLICSTSGGFPRPHLYWLENGEELNATNTTLSQDPETKLYMISSELDFNMTSNHSFLCLVKYGDLTVSQTFYWQESKPTPSANQHLTWTIIIPVSAFGISVIIAVILTCLTCRNAAIRRQRRENEVEMQSCSQSP

SEQ ID NO: 264 - protein, 296 aa, Artificial Sequence
  Description of Artificial Sequence: Synthetic peptide
MGHTMEWGSLPPKRPCLWLSQLLVLTGLFYFCSGITPKSATKRVKETVMLSCDYSTSTEELTSLRIYWQKDSKMVLAILPGKVQVWPEYKNRTITDMNDNPRIVILALRLSDSGTYTCVIQKPDLKGAYKLEHLTSVRLMIRADFPVPTINDLGNPSPNIRRLICSTSGGFPRPHLYWLENGEELNATNTTLSQDPETKLYMISSELDFNMTSNHSFLCLVKYGDLTVSQTFYWQESKPTPSANQHLTWTIIIPVSAFGISVIIAVILTCLTCRNAAIRRQRRENEVEMQSCSQSP

SEQ ID NO: 265 - protein, 295 aa, Artificial Sequence
  Description of Artificial Sequence: Synthetic peptide
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVVQKNENGSFRREHLTSVRLMIRADFPVPTINDLGNPSPNIRRLICSTSGGFPRPHLYWLENGEELNATNTTLPQDPETKLYMISSELDFNMTSNHSFLCLVKYGDLTVSQTFYWQESKPTPSANQHLTWTIIIPVSAFGISVIIAVILTCLTCRNAAIRRQRRENEVEMQSCSQSP

SEQ ID NO: 266 - protein, 295 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDKGTYTCVVQKNENGSFRREHLTSVRLMIRADFPVPTINDLGNPSPNIRRLICSTSGGFPRPHLYWLENGEELNATNTTLSQDPETKLYMISSELDFNMTSNHSFLCLVKYGDLTVSQTFYWQESKPTPSANQHLTWTIIIPVSAFGISVIIAVILTCLTCRNAAIRRQRRENEVEMQSCSQSP

SEQ ID NO: 267 - protein, 296 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDSGTYTCVIQKPDLKGAYKLEHLTSVRLMIRADFPVPTINDLGNPSPNIRRLICSTSGGFPRPHLYWLENGEELNATNTTLSQDPETKLYMISSELDFNMTSNHSFLCLVKYGDLTVSQTFYWQESKPTPSANQHLTWTIIIPVSAFGISVIIAVILTCLTCRNAAIRRQRRENEVEMQSCSQSP

SEQ ID NO: 268 - protein, 302 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTITDMNDNPRIVILALRLSDKGTYTCVVQKNENGSFRREHLTSVTLSIRADFPVPSITDIGHPAPNVKRIRCSASGGFPEPRLYWLENGEELNATNTTVSQDPGTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 269 - protein, 295 aa, Artificial Sequence
  Description of Artificial Sequence: Synthetic peptide
MDHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDKGTYTCVVQKNENGSFRREHLTSVTLSIRADFPVPTINDLGNPSPNIRRLICSTSGGFPRPHLYWLENGEELNATNTTLSQDPETKLYMISSELDFNMTSNHSFLCLVKYGDLTVSQTFYWQESKPTPSANQHLTWTIIIPVSAFGISVIIAVILTCLTCRNAAIRRQRRENEVEMQSCSQSP

SEQ ID NO: 270 - protein, 295 aa, Artificial Sequence
  Description of Artificial Sequence: Synthetic peptide
MGHTMKWGSLPPKRPCLWLSQLLVPTGLFYFCSGITPKSVTKRVKETVMLSCDYNTSTEELTSLRIYWQKDSKMVLAILPGKVQVWPEYKNRTITDMNDNPRIVILALRLSDKGTYTCVVQKNENGSFRREHLTSVTLSIRADFPVPTINDLGNPSPNIRRLICSTSGGFPRPHLYWLENGEELNATNTTLSQDPETKLYMISSELDFNMTSNHSFLCLVKYGDLTVSQTLYWQESKPTPSANQHLTWTIIIPVSAFGISVIIAVILTCLTCRNAAIRRQRRENEVEMQSCSQSP

SEQ ID NO: 271 - protein, 296 aa, Artificial Sequence
  Description of Artificial Sequence: Synthetic peptide
MGHTVKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALPLSDSGTYTCVIQKPDLKGAYKLEHLTSVRLMIRADFPVPTINDLGNPSPNIRRLICSTSGGFPRPHLYWLENGEELNATNTTLSQDPETKLYMISSELDFNMTSNHSFLCLVKYGDLTVSQTFYWQESKPTPSANQHLTWTIIIPVSAFGISVIIAVILTCLTCRNAAIRRQRRENEVEMQSCSQSP

SEQ ID NO: 272 - protein, 302 aa, Artificial Sequence
  Description of Artificial Sequence: Synthetic peptide
MGHTMKWGSLPPKRPCLWLSQLLVLTGLFYFCSGITPKSVTKRVKETVMLSCDYSTSTEELTSLRIYWQKDSKMVLAILPGKVQVWPEYKNRTFPDIINNLSLMILALRLSDRGTYTCVVQKNENGSFRREHLTSVTLSIRADFPVPSITDIGHPAPNVKRIRCSASGGFPEPRLAWMEDGEELNAVNTTVDQDLDTELYSVGSELDFNVTNNHSIVCLIKYGELSVSQIFPWSKPKQEPPIDQLPFWVIIPVSGALVLTAVVLYCLARRHVARWKRTRRNEETVGTERLSPIYLGSAQSSG

SEQ ID NO: 273 - DNA, 867 bp, Homo sapiens
atgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttcctgagcctcacctctcctggctggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtatga

SEQ ID NO: 274 - DNA, 867 bp, Macaca sp.
atgggccacacacggaggcaggaaatatcaccatccaagtgtccatacctcaagttctttcagctcttggtgctggcttgtctttctcatttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcacaaataacctctccattgtgattctggctctgcgcccatctgacgagggcacatacgagtgtgttgttctgaagtatgaaaaagatgctttcaagcgggaacacctggctgaagtgatgttatccgtcaaagctgacttccctacacctagtataactgactctgaaattccaccttctaacattagaaggataatttgctcaaactctggaggttttccagagcctcacctctcctggttggaaaatggagaagaattaaatgccatcagcacaacagtttcccaagatcctgaaactgagctctatactgttagcagcaaactggatttcaatatgacaaccaatcacagtttcatgtgtctcatcaagtatggacatttaagagtgaatcagaccttcaactggaacacacccaagcaagagcattttcctgataacctgctcccatcctgggccattatcctaatctcagtaaatggaatttttgtgatatgctgcctgacctactgttttgccccaaggtgcagagagagaagaaggaatgagacattgagaagggaaagtgtacgccctgtatga

SEQ ID NO: 275 - DNA, 888 bp, Bovine sp.
atgggtcacacaatgaagtggggaacactaccacccaagcgcccatgcctctggctctctcagctcttggtgctcactggtcttttttacttctgttcaggcatcaccccaaagagtgtgaccaaaagagtgaaagaaacagtaatgctatcctgtgattacaacacatccactgaagaactgacaagccttcggatctattggcaaaaggatagtaaaatggtgctggccatcctgcctggaaaagtgcaggtgtggcctgaatacaagaaccgcaccatcactgacatgaacgataacccccgcattgtgatcctggctctgcgcctgtcggacagtggcacctacacctgtgttattcagaagcctgatttgaaaggggcttataaactggagcacctgacttccgtgaggttaatgatcagagctgacttccctgtccctaccataaatgatcttggaaatccatctcctaatatcagaaggctaatttgctcaacctctggaggttttccaaggccccacctctactggttggaaaatggagaagaattaaatgctaccaacacaacactgtcccaagatcctgaaaccaagctctacatgattagcagtgaactggatttcaacatgacaagcaatcacagcttcttgtgtcttgtcaagtatggagacttaacagtgtcacagaccttctactggcaagaatccaaaccaaccccttctgctaatcagcacctgacctggaccattattatcccagtctcagcatttgggatttctgtgatcattgcagttatactaacatgcctgacctgcagaaatgctgcaatacgcagacagagaagggagaatgaagtggaaatggaaagttgctctcagtctcca

SEQ ID NO: 276 - DNA, 900 bp, Oryctolagus cuniculus
atgggccacacgctgaggccgggaactccactgcccaggtgtctacacctcaagctctgcctgctcttggcgctggcgggtctccacttctcttcaggtatcagccaggtcaccaagtcggtgaaagaaatggcagcactgtcctgtgattacaacatttctatcgatgaactggcgagaatgcgcatatactggcagaaggaccaacagatggtgctgagcatcatctctgggcaagtggaagtgtggcctgagtacaagaaccgcaccttccccgacatcattaacaacctctcccttatgatcctggcactgcgcctgtcggacaagggcacctacacctgcgtggttcagaagaatgagaacgggtctttcagacgggagcacctgacctccgtgacactgtccatcagagctgacttccctgtccctagcataactgacattggacatcccgaccctaatgtgaaaaggataagatgctccgcctctggaggttttccagagcctcgcctcgcctggatggaagatggagaagaactaaacgccgtcaacacgacggttgaccaggatttggacacggagctctacagcgtcagcagtgaactggatttcaatgtgacaaataaccacagcatcgtgtgtctcatcaaatacggggagctgtcggtgtcacagatcttcccttggagcaaacccaagcaggagcctcccattgatcagcttccattctgggtcattatcccagtaagtggtgctttggtgctcactgcggtagttctctactgcctggcctgcagacatgttgcgaggtggaaaagaacaagaaggaatgaagagacagtgggaactgaaaggctgtcccctatctacttaggctctgcgcaatcctcgggctga

SEQ ID NO: 277 - DNA, 941 bp, Felis domesticus
atgggtcacgcagcaaagtggaaaacaccactactgaagcacccatatcccaagctctttccgctcttgatgctagctagtcttttttacttctgttcaggtatcatccaggtgaacaagacagtggaagaagtagcagtactatcctgtgattacaacatttccaccaaagaactgacggaaattcgaatctattggcaaaaggatgatgaaatggtgttggctgtcatgtctggcaaagtacaagtgtggcccaagtacaagaaccgcacattcactgacgtcaccgataaccactccattgtgatcatggctctgcgcctgtcagacaatggcaaatacacttgtattattcaaaagattgaaaaagggtcttacaaagtgaaacacctgacttcggtgatgttattggtcagagctgacttccctgtccctagtataactgatcttggaaatccatctcataacatcaaaaggataatgtgcttaacttctggaggttttccaaagcctcacctctcctggctggaaaatgaagaagaattaaatgccatcaacacaacagtttcccaagatcctgaaactgagctctacactattagcagtgaactggatttcaatatgacaaacaaccatagcttcctgtgtcttgtcaagtatggaaacttactagtatcacagatcttcaactggcaaaaatcagagccacagccttctaataatcagctctggatcattatcctgagctcagtagtaagtgggattgttgtgatcactgcacttaccttaagatgcctagtccacagacctgctgcaaggtggagacaaagagaaatggggagagcgcggaaatggaaaagatctcacctgtctacatagattctgcagaaccactgtatgcagagcatctggaggtagcctctttagctcttctctactag

SEQ ID NO: 278 - protein, 288 aa, Homo sapiens
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 279 - protein, 288 aa, Macaca sp.
MGHTRRQGISPSKCPYLKFFQLLVLACLSHLCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVMLSVKADFPTPSITDFEIPPSNIRRIICSTSGGFPEPRLSWLENGEELNAISTTVSQDPETELYTVSSKLDFNMTTNHSFMCLIKYGHLRVNQTFNWNTPKQEHFPDNLLPSWAITLISVNGIFVICCLTHCFAPRCRERRRNETLRRESVRPV

SEQ ID NO: 280 - protein, 296 aa, Bovine sp.
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPDLKGAYKLEHLTSVRLMIRADFPVPTINDLGNPSPNIRRLICSTSGGFPRPHLYWLENGEELNATNTTLSQDPETKLYMISSELDFNMTSNHSFLCLVKYGDLTVSQTFYWQESKPTPSANQHLTWTIIIPVSAFGISVIIAVILTCLTCRNAAIRRQRRENEVEMQSCSQSP

SEQ ID NO: 281 - protein, 299 aa, Oryctolagus cuniculus
MGHTLRPGTPLPRCLHLKLCLLLALAGLHFSSGISQVTKSVKEMAALSCDYNISIDELARMRIYWQKDQQMVLSIISGQVEVWPEYKNRTFPDIINNLSLMILALRLSDKGTYTCVVQKNENGSFRREHLTSVTLSIRADFPVPSITDIGHPAPNVKRIRCSASGGFPEPRLAWMEDGEELNAVNTTVDQDLDTELYSVSSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 282 - protein, 292 aa, Felis domesticus
MGHAAKWKTPLLKHPYPKLFPLLMLASLFYFCSGIIQVNKTVEEVAVLSCDYNISTKELTEIRIYWQKDDEMVLAVMSGKVQVWPKYKNRTFTDVTDNHSIVIMALRLSDNGKYTCIIQKIEKGSYKVKHLTSVMLLVRADFPVPSITDLGNPSHNIKRTMCLTSGGFPKPHLSWLENEEELNAINTTVSQDPETELYTISSELDFNMTNNHSFLCLVKYGNLLVSQIFNWQKSEPQPSNNQLWIIILSSVVSGIVVITALTLRCLVHRPAARWRQREMGRARKWKRSHLST

SEQ ID NO: 283 - protein, 303 aa, Artificial Sequence
  Description of Artificial Sequence: Consensus sequence
MGHTMKWGSLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPVLKGAYKLEHLASVRLMIRADFPVPTINDLGNPSPNIRRLICSTSGGFPRPHLYWLENGEELNATNTTVSQDPDTELYMISSELDFNVTNNHSIVCLIKYGELSVSQIFPWSKPKQEPPIDQLPFWVIIPVSGALVLTAVVLYCLACRHVARWKRTRRNEETVGTERLSPIYLGSAQSSG

SEQ ID NO: 284 - protein, 303 aa, Artificial Sequence
  Description of Artificial Sequence: Synthetic peptide
  MOD_RES (6): Lys or Glu
  MOD_RES (8): Arg or Gly
  MOD_RES (14): Arg or Cys
  MOD_RES (18): Trp or Arg
  MOD_RES (19): Pro or Leu
  MOD_RES (20): Ser or Pro
  MOD_RES (27): Asp or Gly
  MOD_RES (55): Asn or Ser
  MOD_RES (60): Glu or Lys
  MOD_RES (69): Gln or Arg
  MOD_RES (101): Pro or Leu
  MOD_RES (106): Leu or Gln
  MOD_RES (110): Pro or Leu
  MOD_RES (113): Lys or Ser
  MOD_RES (120): Val or Ile
  MOD_RES (124): Val or Asp
  MOD_RES (135): Thr or Ala
  MOD_RES (149): Thr, Ser or deleted
  MOD_RES (150): Ile or deleted
  MOD_RES (151): Asn or Thr
  MOD_RES (167): Thr or deleted
  MOD_RES (168): Ser or deleted
  MOD_RES (169): Gly or deleted
  MOD_RES (177): Cys or Tyr
  MOD_RES (192): Val or Leu
  MOD_RES (197): Gly or Glu
  MOD_RES (199): Glu or Lys
  MOD_RES (208): Gly or Asp
  MOD_RES (215): His or Arg
  MOD_RES (218): Ala or Val
  MOD_RES (227): Ser or Leu
  MOD_RES (249): Trp, Leu or Arg
  MOD_RES (261): Ala or Thr
  MOD_RES (263): Val, Ala or Ile
  MOD_RES (267): Arg or Cys
  MOD_RES (268): Pro or Leu
  MOD_RES (273): Gly or Val
MGHTMXWXSLPPKXPCLXXXQLLVLTXLFYFCSGITPKSVTKRVKETVMLSCDYXTSTEXLTSLRIYWXKDSKMVLAILPGKVQVWPEYKNRTITDMNDNXRIVIXALRXSDXGTYTCVXQKPXLKGAYKLEHLXSVRLMIRADFPVPXXXDLGNPSPNIRRLICSXXXGFPRPHLXWLENGEELNATNTTXSQDPXTXLYMISSELXFNVTNNXSIXCLIKYGELXVSQIFPWSKPKQEPPIDQLPFXVIIPVSGALVLXAXVLYXXACRHXARWKRTRRNEETVGTERLSPIYLGSAQSSG

SEQ ID NO: 285 - protein, 303 aa, Artificial Sequence
  Description of Artificial Sequence: Synthetic peptide
MGHTMKWRSLPPKRPCLWPSQLLVLTDLFYFCSGITPKSVTKRVKETVMLSCDYNTSTEELTSLRIYWQKDSKMVLAILPGKVQVWPEYKNRTITDMNDNPRIVILALRPSDKGTYTCVVQKPVLKGAYKLEHLTSVRLMIRADFPVPTINDLGNPSPNIRRLICSTSGGFPRPHLCWLENGEELNATNTTVSQDPGTELYMISSELGFNVTNNHSIACLIKYGELSVSQIFPWSKPKQEPPIDQLPFWVIIPVSGALVLAAVVLYRPACRHGARWKRTRRNEETVGTERLSPIYLGSAQSSG

SEQ ID NO: 286 - protein, 288 aa, Artificial Sequence
  Description of Artificial Sequence: Consensus sequence
MGHTRRQGISPSKCPYLKFFQLLVLACLSHFCSGVIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVMLSVKADFPTPSISDFEIPPSNIRRIICSTSGGFPEPHLSWLENGEELNAINTTVSQDPETELYTVSSKLDFNMTTNHSFMCLIKYGHLRVNQTFNWNTPKQEHFPDNLLPSWAITLISVNGIFVICCLTYCFAPRCRERRRNERLRRESVRPV

SEQ ID NO: 287 - protein, 288 aa, Artificial Sequence
  Description of Artificial Sequence: Synthetic peptide
  MOD_RES (12): Ser or Pro
  MOD_RES (25): Leu or Met
  MOD_RES (29): Ser or Pro
  MOD_RES (40): Lys or Arg
  MOD_RES (122): Glu or Asp
  MOD_RES (129): Glu or Lys
  MOD_RES (164): Thr or Ala
  MOD_RES (196): Glu or Gly
  MOD_RES (219): Lys or Arg
  MOD_RES (241): Asp or Asn
MGHTRRQGTSPXKCPYLKFFQLLVXACLXHLCSGVIHVTXEVKEVATLSCGLNVSVEELAQTRIHWQKEKKMVLTMMSGDMNIWPEYKNRTIFDITNNLSIVILALRPSDEGTYECVVLKYXKDAFKRXHLAEVMLSVKADFPTPSITDFEIPPSNIRRIICSXSGGFPEPHLFWLENGEELNAINTTVSQDPETXLYTVSSKLDFNMTANHSFMCLIXYGHLRVNQTFNWNTPKQEHFPXNLLPSWAITLISANGIFVICCLTYRFAPRCRERKSNETLRRESVCPV

SEQ ID NO: 288 - protein, 288 aa, Artificial Sequence
  Description of Artificial Sequence: Synthetic peptide
MGHTRRQGTSPPECPYLKFFQLLVMACLPHLCSGVIHVTREVKEVATLPCGLNVSVEELAQTPIHWQKEKKMVLTMMSGDMNIWPEYKNRTIFDITNNLSIVILALRPSDEGTYECVVLKYDKDAFKQKHLAEVMLSVKADFPTPSITDFEIPPSNIKRIICSASGGFPEPHLFGLENGEEINAINTTVSQDPETGLYTVSSKLDFNMTADHNFMCLIRYGHLRVNQTFNWNTPKQEHFPNNPLPSWAITLISANGIFVICCPTYRFAPGCRERKSNETLRRESVCPV

SEQ ID NO: 289 - protein, 288 aa, Artificial Sequence
  Description of Artificial Sequence: Synthetic peptide
MGHTRRQGTSPSKCPYLKFFQLLVLACLSHLCSGVIHVTKEVKEVATLSCGLNVSVEELAQTRIHWQKEKKMVLTMMSGDMNIWPEYKNRTIFDITNNLSIVILALRPSDEGTYECVVLKYEKDAFKREHLAEVMLSVKADFPTPSITDFEIPPSNIRRIICSTSGGFPEPHLFWLENGEELNAINTTVSQDPETELYTVSSKLDFNMTANHSFMCLIKYGHLRVNQTFNWNTPKQEHFPDNLLPSWAITLISANGIFVICCLTYRFAPRCRERKSNETLRRESVCPV

SEQ ID NO: 290 - protein, 275 aa, Artificial Sequence
  Description of Artificial Sequence: Synthetic peptide
  MOD_RES (50): Leu or Pro
  MOD_RES (55): Asn or Ser
  MOD_RES (56): Ala or Thr
  MOD_RES (113): Ser or Lys
  MOD_RES (120): Ile or Val
  MOD_RES (123): Pro or deleted
  MOD_RES (124): Val, Asn or Asp
  MOD_RES (125): Leu or Glu
  MOD_RES (126): Lys or Asn
  MOD_RES (128): Ala or Ser
  MOD_RES (129): Tyr or Phe
  MOD_RES (130): Lys or Arg
  MOD_RES (131): Leu or Arg
  MOD_RES (135): Ala or Thr
  MOD_RES (138): Arg or Thr
  MOD_RES (140): Met or Ser
  MOD_RES (170): Asp or Gly
  MOD_RES (193): Asp or deleted
  MOD_RES (194): Gln or deleted
  MOD_RES (195): Asp or deleted
  MOD_RES (209): Variable amino acid
  MOD_RES (211): Val or Ala
  MOD_RES (252): Ile or Val
  MOD_RES (253): Leu or Pro
MGHTMKWGSLPPKRPCLWLSQLLVLTGLFYFCSGITPKSVTKRVKETVMXSCDYXXSTEELTSLRIYWQKDSKMVLAILPGKVQVWPEYKNRTITDMNDNPRIVILALRLSDXGTYTCVXQKXXXXGXXXXEHLXSVXLXIRADFPVPSITDIGHPAPNVKRIRCSASGXFPEPRLAWMEDGEELNAVNTTVXXXLDTELYSVSSELDXNXTNNHSIVCLIKYGELSVSQIFPWSKPKQEPPIDQLPFWVIXXVSGALVLTAVVLYCLACRHVAR

SEQ ID NO: 291 - protein, 275 aa, Artificial Sequence
  Description of Artificial Sequence: Synthetic peptide
MGHTMKWGSLPPKRPCLWLSQLLVLTGLFYFCSGITPKSVTKRVKETVMLSCDYNASTEELTSLRIYWQKDSKMVLAILPGKVQVWPEYKNRTITDMNDNPRIVILALRLSDSGTYTCVIQKPVLKGAYKLEHLASVRLMIRADFPVPSITDIGHPAPNVKRIRCSASGDFPEPRLAWMEDGEELNAVNTTVDQDLDTELYSVSSELDSNVTNNHSIVCLIKYGELSVSQIFPWSKPKQEPPIDQLPFWVIILVSGALVLTAVVLYCLACRHVAR

SEQ ID NO: 292 - protein, 296 aa, Artificial Sequence
  Description of Artificial Sequence: Synthetic peptide
  MOD_RES (9): Thr or Ser
  MOD_RES (35): Ile or Thr
  MOD_RES (55): Asn or Ser
  MOD_RES (110): Leu or Pro
  MOD_RES (124): Asp or Val
  MOD_RES (135): Thr or Ala
  MOD_RES (183): Lys or Glu
  MOD_RES (192): Leu or Val
  MOD_RES (211): Met or Thr
  MOD_RES (215): His or deleted
  MOD_RES (216): Ser or deleted
  MOD_RES (217): Phe or deleted
  MOD_RES (231): Thr or Ser
  MOD_RES (288): Lys or Glu
  MOD_RES (290): Glu or Gln
MGHTMKWGXLPPKRPCLWLSQLLVLTGLFYFCSGXTPKSVTKRVKETVMLSCDYXTSTEELTSLRIYWQKDSKMVLAILPGKVQVWPEYKNRTITDMNDNPRIVILALRXSDSGTYTCVIQKPXLKGAYKLEHLXSVRLMIRADFPVPTINDLGNPSPNIRRLICSTSGGFPRPHLYWLENGXELNATNTTXSQDPETKLYMISSELDFNXTSNXXXLCLVKYGDLTVSQXFYWQESKPTPSANQHLTWTIIIPVSAFGISVIIAVILTCLTCRNAAIRRQRRENEVXMXSCSQSP

SEQ ID NO: 293 - protein, 296 aa, Artificial Sequence
  Description of Artificial Sequence: Synthetic peptide
MGHTMKWGTLPPKRPCLWLSQLLVLTGLFYFCSGITPKSVTKRVKETVMLSCDYNTSTEELTSLRIYWQKDSKMVLAILPGKVQVWPEYKNRTITDMNDNPRIVILALRLSDSGTYTCVIQKPDLKGAYKLEHLTSVRLMIRADFPVPTINDLGNPSPNIRRLICSTSGGFPRPHLYWLENGKELNATNTTLSQDPETKLYMISSELDFNMTSNHSFLCLVKYGDLTVSQTFYWQESKPTPSANQHLTWTIIIPVSAFGISVIIAVILTCLTCRNAAIRRQRRENEVKMESCSQSP

SEQ ID NO: 294 - protein, 26 aa, Artificial Sequence
  Description of Artificial Sequence: Synthetic peptide
NKDSKMVVAILPGKVQVFPEYKNKTI

SEQ ID NO: 295 - protein, 26 aa, Artificial Sequence
  Description of Artificial Sequence: Synthetic peptide
QKDAKMVLAILPGRVQMWPEYKQRTI

SEQ ID NO: 296 - protein, 8 aa, Artificial Sequence
  Description of Artificial Sequence: Synthetic FLAG tag
DYKDDDDK

SEQ ID NO: 297 - protein, 6 aa, Artificial Sequence
  Description of Artificial Sequence: Illustrative conserved peptide
MYPPPY

SEQ ID NO: 298 - protein, 14 aa, Artificial Sequence
  Description of Artificial Sequence: Illustrative non-dimerizing Ig-Fc domain
PKSCDKTHTCPPCP

SEQ ID NO: 299 - protein, 6 aa, Artificial Sequence
  Description of Artificial Sequence: Poly-His tag
HHHHHH

SEQ ID NO: 300 - protein, 4 aa, Artificial Sequence
  Description of Artificial Sequence: Illustrative factor Xa cleavage site
IEGR

SEQ ID NO: 301 - protein, 14 aa, Artificial Sequence
  Description of Artificial Sequence: Synthetic peptide
PKSSDKTHTSPPSP

SEQ ID NO: 302 - DNA, 46 bp, Artificial Sequence
  Description of Artificial Sequence: Primer
acacatagcgccggcgctagctgagcaaaaggccagcaaaaggcca

SEQ ID NO: 303 - DNA, 60 bp, Artificial Sequence
  Description of Artificial Sequence: Primer
aactctgtgagacaacagtcataaatgtacagatatcagaccaagtttactcatatatac

SEQ ID NO: 304 - DNA, 39 bp, Artificial Sequence
  Description of Artificial Sequence: Primer
ggcttctcacagagtggcgcgccgtgtctcaaaatctct

SEQ ID NO: 305 - DNA, 40 bp, Artificial Sequence
  Description of Artificial Sequence: Primer
ttgctcagctagcgccggcgccgtcccgtcaagtcagcgt

SEQ ID NO: 306 - DNA, 40 bp, Artificial Sequence
  Description of Artificial Sequence: Primer
agatctgtttaaaccgctgatcagcctcgactgtgccttc

SEQ ID NO: 307 - DNA, 40 bp, Artificial Sequence
  Description of Artificial Sequence: Primer
acctctaaccactctgtgagaagccatagagcccaccgca

SEQ ID NO: 308 - DNA, 53 bp, Artificial Sequence
  Description of Artificial Sequence: Primer
ggatccggtacctctagagaattcggcggccgcagatctgtttaaaccgctga

SEQ ID NO: 309 - DNA, 63 bp, Artificial Sequence
  Description of Artificial Sequence: Primer
ggatccactcatctagaacaatggtaccaatacgaattcggcggccgcagatctgtttaaacc

SEQ ID NO: 310 - DNA, 16 bp, Artificial Sequence
  Description of Artificial Sequence: Consensus terminator sequence
atcaaaattaggaaga

SEQ ID NO: 311 - DNA, 15 bp, Artificial Sequence
  Description of Artificial Sequence: Illustrative silent variation oligonucleotide
atgggacatacgatg

SEQ ID NO: 312 - protein, 7 aa, Artificial Sequence
  Description of Artificial Sequence: Illustrative peptide
LYPPPPY

What is claimed is:

1. An isolated or recombinant polypeptide comprising an extracellular domain, said extracellular domain comprising an amino acid sequence having at least 91% sequence identity to a subsequence of the polypeptide sequence set forth in SEQ ID NO:66, wherein the subsequence is the extracellular domain of SEQ ID NO:66, and wherein the isolated or recombinant polypeptide has a human CD28/human CTLA-4 binding affinity ratio equal to or greater than the human CD28/human CTLA-4 binding affinity ratio of human B7-1 when said isolated or recombinant polypeptide is expressed on a cell or bound to a cell membrane.

2. The isolated or recombinant polypeptide of claim 1, wherein the polypeptide is expressed on a cell or bound to a cell membrane.

3. The isolated or recombinant polypeptide of claim 1, wherein the polypeptide comprises an extracellular domain which comprises an amino acid sequence having at least 95% sequence identity to the extracellular domain of SEQ ID NO:66, wherein said extracellular domain of SEQ ID NO:66 comprises at least amino acid residues 35–244 of SEQ ID NO:66.

4. The isolated or recombinant polypeptide of claim 1, wherein the polypeptide comprises an extracellular domain which comprises an amino acid sequence having at least 95% sequence identity to the extracellular domain of SEQ ID NO:66, wherein the extracellular domain of SEQ ID NO;66 comprises at least amino acid residues 35–245 of SEQ ID NO:66.

5. The isolated or recombinant polypeptide of claim 3, wherein the polypeptide comprises art extracellular domain comprising at least amino acid residues 35–244 of SEQ ID NO:66.

6. The isolated or recombinant polypeptide of claim 1, wherein the polypeptide further comprises a signal peptide.

7. The isolated or recombinant polypeptide of claim 6, wherein the signal peptide comprises an amino acid sequence that has at least 90% sequence identity to the amino acid sequence comprising residues 1–34 of SEQ ID NO:66.

8. The isolated or recombinant polypeptide of claim 6, wherein the signal peptide has an amino acid sequence comprising amino acid residues 1–34 of SEQ ID NO:66.

9. The isolated or recombinant polypeptide of claim 1, wherein the polypeptide comprises a transmembrane domain.

10. The isolated or recombinant polypeptide of claim 9, wherein the polypeptide comprises the transmembrane domain of SEQ ID NO:66.

11. The isolated or recombinant polypeptide of claim 10, wherein the transmembrane domain comprises an amino acid sequence having at least 90% sequence identity to an amino acid sequence comprising at least amino acid residues 245–268 or 246–272 of SEQ ID NO:66.

12. The isolated or recombinant polypeptide of claim 11, wherein the transmembrane domain comprises an amino acid sequence comprising at least amino acid residues 245–268 or 246–272 of SEQ ID NO:66.

13. The isolated or recombinant polypeptide of claim 1, wherein the polypeptide further comprises a cytoplasmic domain.

14. The isolated or recombinant polypeptide of claim 13, wherein the polypeptide comprises the cytoplasmic domain of SEQ ID NO:66.

15. The isolated or recombinant polypeptide of claim 13, wherein the cytoplasmic domain comprises an amino acid sequence having at least 90% sequence identity to an amino acid sequence comprising at least amino acid residues 269–303 or 273–303 of SEQ ID NO:66.

16. The isolated or recombinant polypeptide of claim 15, wherein the cytoplasmic domain comprises an amino acid sequence comprising at least amino acid residues 269–303 or 273–303 of SEQ ID NO:66.

17. The isolated or recombinant polypeptide of claim 1, wherein the polypeptide comprises an amino acid sequence having at least 90% sequence identity to the amino acid sequence comprising a mature domain of SEQ ID NO:66.

18. The isolated or recombinant polypeptide of claim 17, wherein the mature domain comprises amino acid residues 35–303 of SEQ ID NO:66.

19. The isolated or recombinant polypeptide of claim 1, wherein the polypeptide comprises an amino acid sequence having at least 90% sequence identity to the amino acid sequence corresponding to the signal peptide, extracellular domain and transmembrane domain of SEQ ID NO:66 which comprises at least amino acid residues 1–268 or 1–272 of SEQ ID NO:66.

20. The isolated or recombinant polypeptide of claim 1, wherein the polypeptide has at least 91% sequence identity to the full length amino acid sequence of SEQ ID NO:66.

21. The isolated or recombinant polypeptide of claim 20, wherein the polypeptide comprises the full length amino acid sequence of SEQ ID NO:66.

22. The isolated or recombinant polypeptide of claim 1, wherein the polypeptide has a human CD28/human CTLA-4 binding affinity ratio greater than the human CD28/human CTLA-4 binding affinity ratio of human B7-1.

23. The isolated or recombinant polypeptide of claim 1, wherein the polypeptide has a binding affinity for CD28 that is greater than the binding affinity of human B7-1 for CD28.

24. The isolated or recombinant polypeptide of claim 1, wherein the polypeptide has a binding affinity for CTLA-4 that is less than the binding affinity of human B7-1 for CTLA-4.

25. The isolated or recombinant polypeptide of claim 1, wherein the polypeptide has an ability to induce a T-cell proliferation response equal to or greater than the T-cell proliferation response induced by human B7-1.

26. An isolated or recombinant polypeptide comprising an extracellular domain, said extracellular domain comprising an amino acid sequence having at least 91% sequence identity to a subsequence of SEQ ID NO:66, said subsequence comprising at least amino acid residues 35–244 or 35–245 of SEQ ID NO:66, wherein said polypeptide induces a T-cell proliferation response equal to or greater than the T-cell proliferation response induced by human B7-1 when said polypeptide is expressed on a cell or bound to a cell membrane.

27. The isolated or recombinant polypeptide of claim 26, wherein the extracellular domain of said polypeptide comprises an amino acid sequence having at least 95% sequence identity to the subsequence of SEQ ID NO:66 that comprises at least amino acid residues 35–244.

28. The isolated or recombinant polypeptide of claim 26, wherein the polypeptide comprises one or more of a signal peptide, transmembrane domain, and cytoplasmic domain.

29. The isolated or recombinant polypeptide of claim 28, wherein the polypeptide comprises an amino acid sequence having at least 95% sequence identity to the full length amino acid sequence of SEQ ID NO:66.

30. The isolated or recombinant polypeptide of claim 1, wherein the cell is an antigen-presenting cell.

31. The polypeptide of claim 1, comprising at least one modified amino acid.

32. The polypeptide of claim 30, wherein the modified amino acid is selected from: a glycosylated amino acid, a PEGylated amino acid, a farnesylated amino acid, an acetylated amino acid, a biotinylated amino acid, an amino acid conjugated to a lipid moiety, and an amino acid conjugated to an organic derivariting agent.

33. An isolated or recombinant polypeptide comprising an amino acid sequence according to the formula:
MGHTM-X6-W-X8-SLPPK-X14-PCL-X18-X19-X20-QLLVLT-X27-LFYFCSGITPKSVT-KRVKETVMLSCDY-X55-TSTE-X60-LTSLRIYW-X69-KDSKMVLAILPGKVQVWPEYKNRTITDMNDN-X101-RIVI-X106-ALR-X110-SD-X113-GTYTCV-X120-QKP-X124-LKGAYKLEHL-X135-SVRLMIRADFPVP-X149-X150-X151-DLGNPSPNIRRLICS-X167-X168-X169-GFPRPHL-X177-WLENGEELNATNTT-X192-SQDP-X197-T-X199-LYMISSEL-X208-FNVTNN-X215-SI-X218-CLIKYGEL-X227-VSQIFPWSKPKQEPPIDQLPF-X249-VIIPVSGALVL-X261-A-X263-VLY-X267-X268-ACRH-X273-ARWKRTRRNEETVGTE RLSPIYLGSAQSSG (SEQ ID NO:284), or a extracellular domain subsequence thereof comprising amino acid residues at positions 35–244,
wherein the amino acid residue at position X6 is Lys or Glu; position X8 is Arg or Gly; position X14 is Arg or Cys; position X18 is Trp or Arg; position X19 is Pro or Leu; position X20 is Ser or Pro; position X27 is Asp or Gly; position X55 is Asn or Ser; position X60 is Glu or Lys; position X69 is Gln or Mg; position X101 is Pro or Leu; position X106 is Leu or Gln; position X110 is Pro or Leu; position X113 is Lys or Ser; position X120 is Val or Ile; position X124 is Val or Asp; position X135 is Thr or Ala; position X149 is Thr, Ser, or deleted; position X150 is Ile or deleted; position X151 is Asn or Thr; position X167 is Thr or deleted; position X169 is Ser or deleted; position X169 is Gly or deleted; position X117 is Cys or Tyr; position X192 is Val or Leu; position X197 is Gly or Glu; position X199 is Glu or Lys; position X208 is Gly or Asp; position X215 is His or Arg; position X218 is Ala or Val; position X227 is Ser or Leu; position X249 is Trp, Leu, or Arg; position X261 is Ala or Thr; position X263 is Val Ala, or Ile; position X267 is Arg or Cys; position X268 is Pro or Leu; and position X273 is Gly or Val, and
wherein the polypeptide has a human CD28/human CTLA-4 binding affinity ratio equal to or greater than the human CD28/human CTLA-4 binding affinity ratio of human B7-1 and/or induces a T-cell proliferation or activation response when the isolated or recombinant polypeptide is expressed on a cell or bound to a cell membrane.

34. The isolated or recombinant polypeptide of claim 33, wherein the polypeptide has a human CD28/human CTLA-4 binding affinity ratio greater than the human CD28/human CTLA-4 binding affinity ratio of human B7-1.

35. The isolated or recombinant polypeptide of claim 33, wherein the polypeptide induces a T-cell proliferation response equal to, or greater than that induced by human B7-1.

36. The isolated or recombinant polypeptide of claim 33, comprising three or more of: Lys at position X6; Arg at position X8; Arg at position X14; Trp at position X18; Pro at position X19; Ser at position X20; Asp at position X27; Asn at position X55; Len at position X106; Pro at position X110; Lys at position X113; Val at position X120; Val at position X124; Thr at position X135; Asn at position X151; Cys at position X177; Val at position X192; Gly at position X197; Glu at position X199; Gly at position X208; His at position 215; Ala at position X218; Trp at position X249; Ala at position X261; Val at position X263; Arg at position X267; Pro at position X268; and Gly at position X273.

37. The isolated or recombinant polypeptide of claim 36, comprising three or more of: Arg at position X8; Arg at position X14; Trp at position X18; Pro at position X19; Ser at position X20; Pro at position X110; Val at position X120; Val at position X124; Cys at position X177; Val at position X192; Gly at position X197; Glu at position X199; Gly at position X208; His at position X215; Ala at position X218; Trp at position X249; Ala at position X261; and Val at position X263.

38. The isolated or recombinant polypeptide of claim 37, comprising amino acid residues 35–244 of SEQ ID NO:66.

39. An isolated or recombinant polypeptide comprising an amino acid sequence having at least 91% sequence identity to the complete amino acid sequence set forth in SEQ ID NO:66, wherein said polypeptide when expressed on a cell or bound to a cell membrane has a human CD28/human CTLA-4 binding affinity ratio at least equal to the human CD28/human CTLA-4 binding affinity ratio of human B7-1 or induces a T-cell proliferation or activation response.

40. A phamaceutical composition comprising a polypeptide of claim 1 and a pharmaceutically acceptable excipient.

41. An isolated or recombinant polypeptide comprising an amino acid sequence comprising at least amino acid residues 245–268 or 246–272 of SEQ ID NO:66.

42. An isolated or recombinant polypeptide comprising an amino acid sequence comprising at least amino acid residues 269–303 or 273–303 of SEQ ID NO:66.

43. The isolated or recombinant polypeptide of claim 6, wherein the polypeptide comprises an amino acid sequence comprising at least amino acid residues 1–244 or 1–245 of SEQ ID NO:66.

44. The isolated or recombinant polypeptide of claim 27, wherein said extracellular domain comprises an amino acid sequence having at least 97% sequence identity to the subsequence of SEQ ID NO:66 comprising at least amino acid residues 35–244.

45. The isolated or recombinant polypeptide of claim 27, wherein said polypeptide when expressed on a cell or bound to a cell membrane induces a T-cell proliferation response greater than the T-cell proliferation response induced by human B7-1.

46. The isolated or recombinant polypeptide of claim 39, wherein said polypeptide comprises an amino acid sequence having at least 95% sequence identity to the complete amino acid sequence of SEQ ID NO:66, and wherein said polypeptide when expressed on a cell or bound to a cell membrane has a human CD28/human CTLA-4 binding affinity ratio that is at least equal to the human CD28/CTLA-4 binding affinity ratio of human B7-1.

47. The isolated or recombinant polypeptide of claim 46, wherein said polypeptide when expressed on a cell or bound to a cell membrane has a human CD28/human CTLA-4 binding affinity ratio that is greater than the human CD28/CTLA-4 binding affinity ratio of human B7-1.

48. The isolated or recombinant polypeptide of claim 39, wherein said polypeptide comprises an amino acid sequence having at least 95% sequence identity to the complete amino acid sequence of SEQ ID NO:66, and wherein said polypeptide when expressed on a cell or bound to a cell membrane induces a T-cell proliferation or activation response.

49. The isolated or recombinant polypeptide of claim 48, wherein said polypeptide comprises an amino acid sequence having at leas 95% sequence identity to the complete amino acid sequence of SEQ ID NO:66, and wherein said polypeptide when expressed on a cell or bound to a cell membrane induces a T-cell proliferation or activation response.

50. The isolated or recombinant polypeptide of claim 49, wherein said polypeptide when expressed on a cell or bound to a cell membrane induces a T-cell proliferation or activation response greater than that induced by human B7-1.

51. A pharmaceutical composition comprising a polypeptide of claim 39 and a pharmaceutically acceptable excipient.

52. A pharmaceutical composition comprising a polypeptide of claim 44 and a pharmaceutically acceptable excipient.

53. A pharmaceutical composition comprising a polypeptide of claim 46 and a pharmaceutically acceptable excipient.

* * * * *

UNITED STATES PATENT AND TRADEMARK OFFICE
CERTIFICATE OF CORRECTION

PATENT NO. : 7,094,875 B2
APPLICATION NO. : 09/888324
DATED : August 22, 2006
INVENTOR(S) : Juha Punnonen et al.

It is certified that error appears in the above-identified patent and that said Letters Patent is hereby corrected as shown below:

Column 319, line 45, delete "art" and insert --at--.

Column 322, line 2, delete "X117" and insert --X177--.

Column 322, line 23, delete "to," and insert --to--.

Column 322, line 34, delete "215" and insert --X215--.

Column 324, line 7, delete "leas" and insert --least--.

Signed and Sealed this

Nineteenth Day of December, 2006

JON W. DUDAS
*Director of the United States Patent and Trademark Office*